(12) United States Patent
Nestor

(10) Patent No.: US 10,005,817 B2
(45) Date of Patent: *Jun. 26, 2018

(54) PEPTIDE PHARMACEUTICALS

(71) Applicant: EUMEDERIS PHARMACEUTICALS, INC., San Diego, CA (US)

(72) Inventor: John J. Nestor, Encinitas, CA (US)

(73) Assignee: EUMEDERIS PHARMACEUTICALS, INC., San Diego, CA (US)

( * ) Notice: Subject to any disclaimer, the term of this patent is extended or adjusted under 35 U.S.C. 154(b) by 0 days. days.

This patent is subject to a terminal disclaimer.

(21) Appl. No.: 14/646,246

(22) PCT Filed: Nov. 20, 2013

(86) PCT No.: PCT/US2013/071067
§ 371 (c)(1),
(2) Date: May 20, 2015

(87) PCT Pub. No.: WO2014/081864
PCT Pub. Date: May 30, 2014

(65) Prior Publication Data
US 2015/0307550 A1    Oct. 29, 2015

Related U.S. Application Data

(60) Provisional application No. 61/728,667, filed on Nov. 20, 2012.

(51) Int. Cl.
| | |
|---|---|
| A61K 47/48 | (2006.01) |
| C07K 7/06 | (2006.01) |
| A61K 38/07 | (2006.01) |
| A61K 38/08 | (2006.01) |
| A61K 38/26 | (2006.01) |
| A61K 38/29 | (2006.01) |
| C07K 1/107 | (2006.01) |
| C07K 5/065 | (2006.01) |
| C09D 101/28 | (2006.01) |
| A61K 38/00 | (2006.01) |

(52) U.S. Cl.
CPC ............... *C07K 7/06* (2013.01); *A61K 38/07* (2013.01); *A61K 38/08* (2013.01); *A61K 38/26* (2013.01); *A61K 38/29* (2013.01); *C07K 1/1077* (2013.01); *C07K 5/06078* (2013.01); *A61K 38/00* (2013.01); *C09D 101/28* (2013.01)

(58) Field of Classification Search
None
See application file for complete search history.

(56) References Cited

U.S. PATENT DOCUMENTS

| 6,864,069 B2 | 3/2005 | Pan et al. |
|---|---|---|
| 2003/0202981 A1 | 10/2003 | Kream |
| 2004/0137557 A1 | 7/2004 | Defrees et al. |
| 2006/0045869 A1 | 3/2006 | Meezan et al. |
| 2007/0111938 A1 | 5/2007 | Pert et al. |
| 2008/0200390 A1 | 8/2008 | Prickett et al. |
| 2008/0227722 A1* | 9/2008 | Wang ............... A61K 38/08 514/15.1 |
| 2008/0268032 A1 | 10/2008 | Maggio |
| 2008/0299079 A1 | 12/2008 | Meezan et al. |
| 2011/0257096 A1 | 10/2011 | Maggio |
| 2014/0349928 A1 | 11/2014 | Nestor |
| 2015/0031630 A1 | 1/2015 | Nestor |
| 2015/0290334 A1 | 10/2015 | Nestor |
| 2017/0096468 A1 | 4/2017 | Nestor |

FOREIGN PATENT DOCUMENTS

| CN | 1635901 A | 7/2005 | |
|---|---|---|---|
| EP | 3155017 A1 | 4/2017 | |
| JP | H1160598 A | 3/1999 | |
| JP | 2003502364 A | 1/2003 | |
| RU | 2181729 C1 * | 4/2002 | ............... C07K 9/00 |
| WO | WO-9500151 A1 | 1/1995 | |
| WO | WO-0078302 A1 | 12/2000 | |
| WO | WO-02098446 A1 | 12/2002 | |
| WO | WO-2006064530 A2 | 6/2006 | |
| WO | WO-2006121860 A2 | 11/2006 | |
| WO | WO2007060692 A2 * | 5/2007 | ............... C07K 7/06 |
| WO | WO-2009155258 A2 | 12/2009 | |
| WO | WO-2010151703 A1 | 12/2010 | |
| WO | WO-2012158962 A2 | 11/2012 | |
| WO | WO-2012158965 A2 | 11/2012 | |
| WO | WO-2012158965 A3 | 1/2013 | |
| WO | WO-2014081864 A1 | 5/2014 | |
| WO | WO-2014081872 A1 | 5/2014 | |
| WO | WO-2015184177 A1 | 12/2015 | |

OTHER PUBLICATIONS

CAS 69227-93-6. n-Dodecyl-β-D-maltoside. Santa Cruz Biotech, 2007.*
Bryant et al. Dmt and opioid peptides: a potent alliance. Biopolymers. 2003;71(2):86-102.*
Suhara, et al. Peptide-Sugar Hybrids: Like Peptide, Like Oligosaccharide. Tetrahedron Letters, vol. 38, No. 41, pp. 7167-7170, 1997.*
Peter Vinke. Oxidation of carbohydrates and derivatives using carbon supported noble metal catalysts. Dissertation 1991.*
Kalyuzhin et al. Biological Activity of Anomeric Pairs of Lipophilic Glycosides of N-Acetylmuramyl-L-Alanyl-D-Isoglutamine. Bulletin of Experimental Biology and Medicine, vol. 145, No. 5, May 2008.*
RN 115414-60-3 from the original source Zemlyakov et al. (Bioorganicheskaya Khimiya, vol. 13, Issue: 11, pp. 1575-1578, Journal, 1987, CODEN: BIKHD7, ISSN: 0132-3423, published in Russian).*
Saurer et al. Neuroimmune mechanisms of opioid-mediated conditioned immunomodulation. Brain Behav Immun. Jan. 2008; 22(1): 89-97.*

(Continued)

*Primary Examiner* — Marcela M Cordero Garcia
*Assistant Examiner* — Jia-Hai Lee
(74) *Attorney, Agent, or Firm* — Wilson Sonsini Goodrich & Rosati

(57) ABSTRACT

Described herein are methods of syntheses and therapeutic uses of covalently modified peptides and/or proteins. The covalently modified peptides and/or proteins allow for improved pharmaceutical properties of peptide and protein-based therapeutics.

24 Claims, 69 Drawing Sheets

(56) References Cited

OTHER PUBLICATIONS

Matsumoto et al. Stimulation of nonspecific resistance to infection induced by muramyl dipeptide analogs substituted in the gamma-carboxyl group and evaluation of N alpha-muramyl dipeptide-N epsilon-stearoyllysine. Infect Immun. Mar. 1983;39(3):1029-40.*
BACHEM compound H-8865. http://shop.bachem.com/h-8865.html. downloaded Aug. 23, 2017.*
Savic et al., From conventional towards new-natural surfactants in drug delivery systems design: current status and perspectives. Expert Opinion on Drug Delivery, 7(3):353-369, 2010.
Bryant et al., Dmt and opioid peptides: A potent alliance. Biopolymers (Peptide Science), 71:86-102, 2003.
Constantino et al., Peptide-derivatized biodegradable nanoparticles able to cross the blood-brain barrier. Journal of Controlled Release, 108:84-96, 2005.
Drouillat et al. Solid Phase Synthesis of C-Terminal Carbohydrate Modified Enkephalins. Bioorganic & Medicinal Chemistry Letters. 1997; 7(17): 2247-2250.
Egleton and Davis, Development of neuropeptide drugs that cross the blood-brain barrier. The Journal of the American Society for Experimental NeuroTherapeutics, 2:44-53, 2005.
European Patent Application No. 12784971.9 Supplementary European Search Report dated Jan. 21, 2015.
European Patent Application No. 12785861.1 Extended European Search Report dated Sep. 12, 2014.
European Patent Application No. 13856357.2 Extended European Search Report dated May 2, 2016.
European Patent Application No. 13857269.8 extended European Search Report dated Apr. 29, 2016.
Farkas et al., Chemical conjugation of biomacromolecules: A mini-review Chemical Papers, 64(6):683-695 (2010).
Keresztes et al. Recent advances in endomorphin engineering. ChemMedChem 5(8):1176-1196 (2010).
Koda et al. Synthesis and in vitro evaluation of a library of modified endomorphin 1 peptides. Bioorganic & Medicinal Chemistry, 16(11):6286-6296 (2008).
Nonyl beta-D-glucopyranoside chemical structure. PubChem Compound Summary for CID 155448. 17 pages, printed Jan. 12, 2016.
Paulick and Bertozzi, The Glycosylphosphatidy[inosito] anchor: A complex membrane-anchoring structure for proteins Biochemistry, 47:6991-7000 (2008).
PCT Patent Application No. PCT/US2012/038433 International Search Report dated Oct. 29, 2012.
PCT Patent Application No. PCT/US2012/038433 Written Opinion dated Oct. 29, 2012.
PCT Patent Application No. PCT/US2013/071067 International Preliminary Report on Patentability dated Jun. 4, 2015.
PCT Patent Application No. PCT/US2013/071077 International Preliminary Report on Patentability dated Jun. 4, 2015.
PCT Patent Application No. PCT/US2012/038433 International Preliminary Report on Patentability dated Nov. 19, 2013.
PCT Patent Application No. PCT/US2012/038429 International Preliminary Report on Patentability dated Nov. 19, 2013.
PCT Patent Application No. PCT/US2012/038429 International Search Report and Written Opinion of the International Searching Authority dated Mar. 28, 2013.
PCT Patent Application No. PCT/US2012/038434 International Preliminary Report on Patentability dated Nov. 19, 2013.
PCT Patent Application No. PCT/US2012/038434 International Search Report and Written Opinion dated Nov. 9, 2012.
PCT Patent Application No. PCT/US2013/071067 International Search Report dated Feb. 25, 2014.
PCT Patent Application No. PCT/US2013/071077 International Search Report dated Mar. 14, 2014.
PCT Patent Application No. PCT/US2015/033042 International Search Report and Written Opinion dated Aug. 25, 2015.
Pillion et al., Systemic absorption of insulin and glucagon applied topically to the eyes of rats and a diabetic dog. Journal of Ocular Pharmacology and Therapeutics, 11(3):13 pages, 1995.
PubChemCompound, datasheet [online compound summary] retrieved from the Internet:<URL:http://pubchem.ncbi.nlm.nih.gov/summary/summary.cgi?cid=11708016&loc=ec_rcs> Oct. 27, 2006; See CID 11708016, 9 pages.
PubChemCompound, datasheet [online compound summary] retrieved from the Internet:<URL:http://pubchem.ncbi.nlm.nih.gov/summary/summary.cgi?cid=11600623&loc=ec_rcs> Oct. 27, 2006; See CID 11600623, 9 pages.
Ribosa et al., Solubilization of large unilamellar liposomes by alkyl glycosides Journal of Colloid and Interface Science, 187:443-446 (1997).
Santa Cruz Biotech Product Block. n-Dodecyl-B-D-maltoside (CAS 69227-93-6). printed Dec. 18, 2015, 2 pages.
Sasaki et al., "X-ray analysis of glucagon and its relationship to receptor binding." Nature, 257:751-757, 1975. Abstract only.
Suhara et al., Peptide-sugar hybrids: Like peptide, like oligosaccharide. Tetrahedron Letters, 38(41):7167-7170, 1997.
U.S. Appl. No. 14/118,546 Office Action dated Jan. 17, 2017.
Ferguson et al., Glycosyl-Phosphatidylinositol moiety that anchors trypanosoma brucei variant surface glycoprotein to the membrane Science, 239:753-759 (1988).
U.S. Appl. No. 14/118,546 Office Action dated Sep. 6, 2017.

* cited by examiner

Figure 1

Table 1

| Compound | SEQ. ID. NO. | 1 | 2 | 3 | 4 | |
|---|---|---|---|---|---|---|
| EU-A101 | 2 | Dmt | Pro | Tmp | Lys(C1-Glucuronyl) | NH2 |
| EU-A102 | 3 | Dmt | Pro | Tmp | Lys(C8-Glucuronyl) | NH2 |
| EU-A103 | 4 | Dmt | Pro | Tmp | Lys(C12-Glucuronyl) | NH2 |
| EU-A105 | 5 | Dmt | Pro | Tmp | Phe | Lys(C1-Glucuronyl)# |
| EU-A106 | 6 | Dmt | Pro | Tmp | Phe | Lys(C12-Glucuronyl)# |
| EU-A107 | 7 | Dmt | D-Lys(C1-Glucuronyl) | TMP | Phe | NH2 |
| EU-A108 | 8 | Dmt | D-Lys(C12-Glucuronyl) | TMP | Phe | NH2 |
| EU-A109 | 9 | Dmt | D-Lys(C8-Glucuronyl) | TMP | Phe | NH2 |
| EU-A110 | 10 | Dmt | D-Lys(C10-Glucuronyl) | TMP | Phe | NH2 |
| EU-A111 | 11 | Dmt | D-Lys(C16-Glucuronyl) | TMP | Phe | NH2 |
| EU-A112 | 12 | Dmt | D-Lys(C18-Glucuronyl) | TMP | Phe | NH2 |
| EU-A113 | 13 | Dmt | D-Lys(C20-Glucuronyl) | TMP | Phe | NH2 |
| EU-A114 | 14 | Dmt | D-Lys(C22-Glucuronyl) | TMP | Phe | NH2 |
| EU-A115 | 15 | Dmt | D-Lys(C24-Glucuronyl) | TMP | Phe | NH2 |
| EU-A116 | 16 | Dmt | D-Lys(OPEG2k-Glucuronyl) | TMP | Phe | NH2 |
| EU-A117 | 17 | Dmt | D-Lys(OPEG30k-Glucuronyl) | TMP | Phe | NH2 |
| EU-A118 | 18 | Dmt | D-Lys(C1-Glucuronyl) | Nal(1) | Phe | NH2 |
| EU-A119 | 19 | Dmt | D-Lys(C12-Glucuronyl) | Nal(1) | Phe | NH2 |
| EU-A120 | 20 | Dmt | D-Lys(C8-Glucuronyl) | Nal(1) | Phe | NH2 |
| EU-A121 | 21 | Dmt | D-Lys(C10-Glucuronyl) | Nal(1) | Phe | NH2 |
| EU-A122 | 22 | Dmt | D-Lys(C16-Glucuronyl) | Nal(1) | Phe | NH2 |
| EU-A123 | 23 | Dmt | D-Lys(C18-Glucuronyl) | Nal(1) | Phe | NH2 |
| EU-A124 | 24 | Dmt | D-Lys(C20-Glucuronyl) | Nal(1) | Phe | NH2 |

Figure 1(continued)

Table 1 (continued)

| Compound | SEQ. ID. NO. | 1 | 2 | 3 | 4 | |
|---|---|---|---|---|---|---|
| EU-A125 | 25 | Dmt | D-Lys(C22-Glucuronyl) | Nal(1) | Phe | NH2 |
| EU-A126 | 26 | Dmt | D-Lys(C24-Glucuronyl) | Nal(1) | Phe | NH2 |
| EU-A127 | 27 | Dmt | D-Lys(OPEG2k-Glucuronyl) | Nal(1) | Phe | NH2 |
| EU-A128 | 28 | Dmt | D-Lys(OPEG30k-Glucuronyl) | Nal(1) | Phe | NH2 |
| EU-A129 | 29 | Dmt | D-Lys(C1-Glucuronyl) | TMP | Lys | NH2 |
| EU-A130 | 30 | Dmt | D-Lys(C12-Glucuronyl) | TMP | Lys | NH2 |
| EU-A131 | 31 | Dmt | D-Lys(C8-Glucuronyl) | TMP | Lys | NH2 |
| EU-A132 | 32 | Dmt | D-Lys(C10-Glucuronyl) | TMP | Lys | NH2 |
| EU-A133 | 33 | Dmt | D-Lys(C16-Glucuronyl) | TMP | Lys | NH2 |
| EU-A134 | 34 | Dmt | D-Lys(C18-Glucuronyl) | TMP | Lys | NH2 |
| EU-A135 | 35 | Dmt | D-Lys(C20-Glucuronyl) | TMP | Lys | NH2 |
| EU-A136 | 36 | Dmt | D-Lys(C22-Glucuronyl) | TMP | Lys | NH2 |
| EU-A137 | 37 | Dmt | D-Lys(C24-Glucuronyl) | TMP | Lys | NH2 |
| EU-A138 | 38 | Dmt | D-Lys(OPEG2k-Glucuronyl) | TMP | Lys | NH2 |
| EU-A139 | 39 | Dmt | D-Lys(OPEG30k-Glucuronyl) | TMP | Lys | NH2 |
| EU-A140 | 40 | Dmt | D-Lys(C1-Glucuronyl) | Nal(2) | Lys | NH2 |
| EU-A141 | 41 | Dmt | D-Lys(C12-Glucuronyl) | Nal(2) | Lys | NH2 |
| EU-A142 | 42 | Dmt | D-Lys(C8-Glucuronyl) | Nal(2) | Lys | NH2 |
| EU-A143 | 43 | Dmt | D-Lys(C10-Glucuronyl) | Nal(2) | Lys | NH2 |
| EU-A144 | 44 | Dmt | D-Lys(C16-Glucuronyl) | Nal(2) | Lys | NH2 |
| EU-A145 | 45 | Dmt | D-Lys(C18-Glucuronyl) | Nal(2) | Lys | NH2 |
| EU-A146 | 46 | Dmt | D-Lys(C20-Glucuronyl) | Nal(2) | Lys | NH2 |
| EU-A147 | 47 | Dmt | D-Lys(C22-Glucuronyl) | Nal(2) | Lys | NH2 |
| EU-A148 | 48 | Dmt | D-Lys(C24-Glucuronyl) | Nal(2) | Lys | NH2 |

Figure 1(continued)

Table 1 (continued)

| Compound | SEQ. ID. NO. | 1 | 2 | 3 | 4 | |
|---|---|---|---|---|---|---|
| EU-A149 | 49 | Dmt | D-Lys(OPEG2k-Glucuronyl) | Nal(2) | Lys | NH2 |
| EU-A150 | 50 | Dmt | D-Lys(OPEG30k-Glucuronyl) | Nal(2) | Lys | NH2 |
| EU-A151 | 51 | Dmt | D-Lys(C1-Glucuronyl) | Phe | Lys | NH2 |
| EU-A152 | 52 | Dmt | D-Lys(C12-Glucuronyl) | Phe | Lys | NH2 |
| EU-A153 | 53 | Dmt | D-Lys(C8-Glucuronyl) | Phe | Lys | NH2 |
| EU-A154 | 54 | Dmt | D-Lys(C10-Glucuronyl) | Phe | Lys | NH2 |
| EU-A155 | 55 | Dmt | D-Lys(C16-Glucuronyl) | Phe | Lys | NH2 |
| EU-A156 | 56 | Dmt | D-Lys(C18-Glucuronyl) | Phe | Lys | NH2 |
| EU-A157 | 57 | Dmt | D-Lys(C20-Glucuronyl) | Phe | Lys | NH2 |
| EU-A158 | 58 | Dmt | D-Lys(C22-Glucuronyl) | Phe | Lys | NH2 |
| EU-A159 | 59 | Dmt | D-Lys(C24-Glucuronyl) | Phe | Lys | NH2 |
| EU-A160 | 60 | Dmt | D-Lys(OPEG2k-Glucuronyl) | Phe | Lys | NH2 |
| EU-A161 | 61 | Dmt | D-Lys(OPEG30k-Glucuronyl) | Phe | Lys | NH2 |
| EU-A162 | 62 | Dmt | Pro | Phe | Lys(C1-Glucuronyl) | NH2 |
| EU-A163 | 63 | Dmt | Pro | Phe | Lys(C8-Glucuronyl) | NH2 |
| EU-A164 | 64 | Dmt | Pro | Phe | Lys(C12-Glucuronyl) | NH2 |
| EU-A165 | 65 | Dmt | Pro | Phe | D-Lys(C1-Glucuronyl) | NH2 |
| EU-A166 | 66 | Dmt | Pro | Phe | D-Lys(C8-Glucuronyl) | NH2 |
| EU-A167 | 67 | Dmt | Pro | Phe | D-Lys(C12-Glucuronyl) | NH2 |
| EU-A168 | 68 | Dmt | Pro | Phe | Lys(C1-Glucuronyl) | Pro# |
| EU-A169 | 69 | Dmt | Pro | Phe | Lys(C8-Glucuronyl) | Pro# |
| EU-A170 | 70 | Dmt | Pro | Phe | Lys(C12-Glucuronyl) | Pro# |
| EU-A171 | 71 | Dmt | Pro | Phe | MeLys(C1-Glucuronyl) | NH2 |
| EU-A172 | 72 | Dmt | Pro | Phe | MeLys(C8-Glucuronyl) | NH2 |

Figure 1(continued)

Table 1 (continued)

| Compound | SEQ. ID. NO. | 1 | 2 | 3 | 4 | |
|---|---|---|---|---|---|---|
| EU-A173 | 73 | Dmt | Pro | Phe | MeLys(C12-Glucuronyl) | NH2 |
| EU-A174 | 74 | Dmt | Pro | Phe | Phe | Lys(C1-Glucuronyl)# |
| EU-A175 | 75 | Dmt | Pro | Phe | Phe | Lys(C12-Glucuronyl)# |
| EU-A176 | 76 | Dmt | Pro | Phe | Phe | MeLys(C1-Glucuronyl)# |
| EU-A177 | 77 | Dmt | Pro | Phe | Phe | MeLys(C12-Glucuronyl)# |
| EU-A178 | 78 | Dmt | Tic | Phe | Lys(C1-Glucuronyl) | NH2 |
| EU-A179 | 79 | Dmt | Tic | Phe | Lys(C12-Glucuronyl) | NH2 |
| EU-A180 | 80 | Dmt | Tic | Phe | Lys(C8-Glucuronyl) | NH2 |
| EU-A181 | 81 | Dmt | Tic | Phe | Lys(C10-Glucuronyl) | NH2 |
| EU-A182 | 82 | Dmt | Tic | Phe | Lys(C16-Glucuronyl) | NH2 |
| EU-A183 | 83 | Dmt | Tic | Phe | Lys(C18-Glucuronyl) | NH2 |
| EU-A184 | 84 | Dmt | Tic | Phe | Lys(C20-Glucuronyl) | NH2 |
| EU-A185 | 85 | Dmt | Tic | Phe | Lys(C22-Glucuronyl) | NH2 |
| EU-A186 | 86 | Dmt | Tic | Phe | Lys(C24-Glucuronyl) | NH2 |
| EU-A187 | 87 | Dmt | Tic | Phe | Lys(OPEG2k-Glucuronyl) | NH2 |
| EU-A188 | 88 | Dmt | Tic | Phe | Lys(OPEG30k-Glucuronyl) | NH2 |
| EU-A189 | 89 | Dmt | Tic | Phe | Phe | Lys(C1-Glucuronyl)# |
| EU-A190 | 90 | Dmt | Tic | Phe | Phe | Lys(C12-Glucuronyl)# |
| EU-A191 | 91 | Dmt | Tic | Phe | Phe | Lys(C8-Glucuronyl)# |
| EU-A192 | 92 | Dmt | Tic | Phe | Phe | Lys(C10-Glucuronyl)# |
| EU-A193 | 93 | Dmt | Tic | Phe | Phe | Lys(C16-Glucuronyl)# |
| EU-A194 | 94 | Dmt | Tic | Phe | Phe | Lys(C18-Glucuronyl)# |
| EU-A195 | 95 | Dmt | Tic | Phe | Phe | Lys(C20-Glucuronyl)# |

Figure 1(continued)

Table 1 (continued)

| Compound | SEQ. ID. NO. | 1 | 2 | 3 | 4 | |
|---|---|---|---|---|---|---|
| EU-A196 | 96 | Dmt | Tic | Phe | Phe | Lys(C22-Glucuronyl)# |
| EU-A197 | 97 | Dmt | Tic | Phe | Phe | Lys(C24-Glucuronyl)# |
| EU-A198 | 98 | Dmt | Tic | Phe | Phe | Lys(OPEG2k-Glucuronyl)# |
| EU-A199 | 99 | Dmt | Tic | Phe | Phe | Lys(OPEG30k-Glucuronyl)# |
| EU-A600 | 100 | Dmt | Tic | Phe | Lys(C1-Glucuronyl) | Aib# |
| EU-A601 | 101 | Dmt | Tic | Phe | Lys(C8-Glucuronyl) | Aib# |
| EU-A602 | 102 | Dmt | Tic | Phe | Lys(C10-Glucuronyl) | Aib# |
| EU-A603 | 103 | Dmt | Tic | Phe | Lys(C12-Glucuronyl) | Aib# |
| EU-A604 | 104 | Dmt | Tic | Phe | Lys(C16-Glucuronyl) | Aib# |
| EU-A605 | 105 | Dmt | Tic | Phe | Lys(C1-Glucuronyl) | Ac5c# |
| EU-A606 | 106 | Dmt | Tic | Phe | Lys(C8-Glucuronyl) | Ac5c# |
| EU-A607 | 107 | Dmt | Tic | Phe | Lys(C10-Glucuronyl) | Ac5c# |
| EU-A608 | 108 | Dmt | Tic | Phe | Lys(C12-Glucuronyl) | Ac5c# |
| EU-A609 | 109 | Dmt | Tic | Phe | Lys(C16-Glucuronyl) | Ac5c# |
| EU-A610 | 110 | Dmt | Tic | Phe | D-Lys(C1-Glucuronyl) | Aib# |
| EU-A611 | 111 | Dmt | Tic | Phe | D-Lys(C8-Glucuronyl) | Aib# |
| EU-A612 | 112 | Dmt | Tic | Phe | D-Lys(C10-Glucuronyl) | Aib# |
| EU-A613 | 113 | Dmt | Tic | Phe | D-Lys(C12-Glucuronyl) | Aib# |
| EU-A614 | 114 | Dmt | Tic | Phe | D-Lys(C16-Glucuronyl) | Aib# |
| EU-A615 | 115 | Dmt | Tic | Phe | D-Lys(C1-Glucuronyl) | NH2 |
| EU-A616 | 116 | Dmt | Tic | Phe | D-Lys(C8-Glucuronyl) | NH2 |
| EU-A617 | 117 | Dmt | Tic | Phe | D-Lys(C10-Glucuronyl) | NH2 |
| EU-A618 | 118 | Dmt | Tic | Phe | D-Lys(C12-Glucuronyl) | NH2 |
| EU-A619 | 119 | Dmt | Tic | Phe | D-Lys(C16-Glucuronyl) | NH2 |

Figure 1(continued)

Table 1 (continued)

| Compound | SEQ. ID. NO. | 1 | 2 | 3 | 4 | |
|---|---|---|---|---|---|---|
| EU-A620 | 120 | Dmt | Tic | Phe | Lys(C1-Glucuronyl) | NH-CH2-Ph |
| EU-A621 | 121 | Dmt | Tic | Phe | Lys(C8-Glucuronyl) | NH-CH2-Ph |
| EU-A622 | 122 | Dmt | Tic | Phe | Lys(C10-Glucuronyl) | NH-CH2-Ph |
| EU-A623 | 123 | Dmt | Tic | Phe | Lys(C12-Glucuronyl) | NH-CH2-Ph |
| EU-A624 | 124 | Dmt | Tic | Phe | Lys(C16-Glucuronyl) | NH-CH2-Ph |
| EU-A625 | 125 | Dmt | Tic | Phe | Lys(C1-Glucuronyl) | NH-CH2-Ph-F |
| EU-A626 | 126 | Dmt | Tic | Phe | Lys(C8-Glucuronyl) | NH-CH2-Ph-F |
| EU-A627 | 127 | Dmt | Tic | Phe | Lys(C10-Glucuronyl) | NH-CH2-Ph-F |
| EU-A628 | 128 | Dmt | Tic | Phe | Lys(C12-Glucuronyl) | NH-CH2-Ph-F |
| EU-A629 | 129 | Dmt | Tic | Phe | Lys(C16-Glucuronyl) | NH-CH2-Ph-F |
| EU-A630 | 130 | Dmt | D-Lys(C1-Glucuronyl) | Phe | Aib | NH2 |
| EU-A631 | 131 | Dmt | D-Lys(C8-Glucuronyl) | Phe | Aib | NH2 |
| EU-A632 | 132 | Dmt | D-Lys(C10-Glucuronyl) | Phe | Aib | NH2 |
| EU-A633 | 133 | Dmt | D-Lys(C12-Glucuronyl) | Phe | Aib | NH2 |
| EU-A634 | 134 | Dmt | D-Lys(C16-Glucuronyl) | Phe | Aib | NH2 |
| EU-A635 | 135 | Dmt | Pro | Phe | Lys(C1-Glucuronyl) | Aib# |
| EU-A636 | 136 | Dmt | Pro | Phe | Lys(C8-Glucuronyl) | Aib# |
| EU-A637 | 137 | Dmt | Pro | Phe | Lys(C10-Glucuronyl) | Aib# |
| EU-A638 | 138 | Dmt | Pro | Phe | Lys(C12-Glucuronyl) | Aib# |
| EU-A639 | 139 | Dmt | Tic | Phe | D-Lys(C1-Glucuronyl) | NH-CH2-Ph |
| EU-A640 | 140 | Dmt | Tic | Phe | D-Lys(C8-Glucuronyl) | NH-CH2-Ph |
| EU-A641 | 141 | Dmt | Tic | Phe | D-Lys(C10-Glucuronyl) | NH-CH2-Ph |
| EU-A642 | 142 | Dmt | Tic | Phe | D-Lys(C12-Glucuronyl) | NH-CH2-Ph |
| EU-A643 | 143 | Dmt | Tic | Phe | D-Lys(C16-Glucuronyl) | NH-CH2-Ph |

Figure 1(continued)

Table 1 (continued)

| Compound | SEQ. ID. NO. | 1 | 2 | 3 | 4 | |
|---|---|---|---|---|---|---|
| EU-A644 | 144 | Dmt | Tic | Phe | D-Lys(C1-Glucuronyl) | NH-CH2-Ph-F |
| EU-A645 | 145 | Dmt | Tic | Phe | D-Lys(C8-Glucuronyl) | NH-CH2-Ph-F |
| EU-A646 | 146 | Dmt | Tic | Phe | D-Lys(C10-Glucuronyl) | NH-CH2-Ph-F |
| EU-A647 | 147 | Dmt | Tic | Phe | D-Lys(C12-Glucuronyl) | NH-CH2-Ph-F |
| EU-A648 | 148 | Dmt | Tic | Phe | D-Lys(C16-Glucuronyl) | NH-CH2-Ph-F |
| EU-A649 | 645 | Dmt | Tic | Phe | Lys(C14-glucuronyl)- | NH2 |

Where used, # means C-terminal amide

Figure 2

Table 2

| | SEQ. ID. NO. | 1 | 2 | 3 | 4 | 5 | 6 | 7 | 8 | 9 | 10 | 11 | 12 | 13 | 14 | 15 | 16 | 17 | 18 | 19 | 20 | 21 |
|---|---|---|---|---|---|---|---|---|---|---|---|---|---|---|---|---|---|---|---|---|---|---|
| EU-201 | 175 | Ac5c | V | Aib | E | I | Q | L | Nle | H | Q | hR | A | R | F | I | Q | Lys(C1)-# | | | | |
| EU-202 | 176 | Ac5c | V | Aib | E | I | Q | L | Nle | H | Q | hR | A | R | F | I | Q | Lys(C8)-# | | | | |
| EU-203 | 177 | Ac5c | V | Aib | E | I | Q | L | Nle | H | Q | hR | A | R | F | I | Q | Lys(C12)-# | | | | |
| EU-204 | 178 | Ac5c | V | Aib | E | I | Q | L | Nle | H | Q | hR | A | R | F | I | Q | Lys(C12)-# | | | | |
| EU-205 | 179 | Ac5c | V | Aib | E | I | Q | L | Nle | H | Q | hR | A | R | W | I | Lys(C12)-# | | | | | |
| EU-206 | 180 | Ac5c | V | Aib | E | I | Q | L | Nle | H | Q | hR | A | R | W | I | Q | Aib | Lys(C12)-# | | | |
| EU-207 | 181 | Ac5c | V | Aib | E | I | Q | L | Nle | H | Q | hR | A | R | F | I | Q | Aib | Lys(C12)-# | | | |
| EU-208 | 182 | Ac5c | V | Aib | E | I | Q | L | Nle | H | Q | hR | A | R | W | I | Q | Aib | Lys(C16)-# | | | |
| EU-209 | 183 | Ac5c | V | Aib | E | I | Q | L | Nle | H | Q | hR | A | R | W | I | Q | D | L | R | Aib | Lys(C8)-# |
| EU-210 | 184 | Ac5c | V | Aib | E | I | Q | L | Nle | H | Q | hR | A | R | W | I | Q | D | L | R | Aib | Lys(C12)-# |
| EU-211 | 185 | Ac5c | V | Aib | E | I | Q | L | Nle | H | Q | hR | A | R | W | I | Q | D | L | R | Aib | Lys(C16)-# |
| EU-212 | 186 | Ac5c | V | Aib | E | I | Q | L | Nle | H | Q | hR | Aib | R | F | I | Q | Lys(C1)-# | | | | |
| EU-213 | 187 | Ac5c | V | Aib | E | I | Q | L | Nle | H | Q | hR | Aib | R | F | I | Q | Lys(C8)-# | | | | |
| EU-214 | 189 | Ac5c | V | Aib | E | I | Q | L | Nle | H | Q | hR | Aib | R | F | I | Q | Lys(C12)-# | | | | |
| EU-215 | 190 | Ac5c | V | Aib | E | I | Q | L | Nle | H | Q | hR | Aib | R | W | I | Q | Lys(C12)-# | | | | |
| EU-216 | 191 | Ac5c | V | Aib | E | I | Q | L | Nle | H | Q | hR | Aib | R | W | Aib | Lys(C12)-# | | | | | |
| EU-217 | 192 | Ac5c | V | Aib | E | I | Q | L | Nle | H | Q | hR | Aib | R | W | Aib | Q | Aib | Lys(C12)-# | | | |
| EU-218 | 193 | Ac5c | V | Aib | E | I | Q | L | Nle | H | Q | hR | Aib | R | W | I | Q | Aib | Lys(C12)-# | | | |
| EU-219 | 194 | Ac5c | V | Aib | E | I | Q | L | Nle | H | Q | hR | Aib | R | Nal2 | I | Q | Aib | Lys(C16)-# | | | |
| EU-220 | 195 | Ac5c | V | Aib | E | I | Q | L | Nle | H | Q | hR | Aib | R | W | I | Q | Aib | Lys(C12)-# | | | |
| EU-221 | 196 | Ac5c | V | Aib | E | I | Q | L | Nle | H | Q | hR | Aib | R | F | I | Q | Aib | Lys(C12)-# | | | |
| EU-222 | 197 | Ac5c | V | Aib | E | I | Q | L | Nle | H | Q | hR | Aib | R | Nal2 | I | Q | Aib | Lys(C12)-# | | | |
| EU-223 | 198 | Ac5c | V | Aib | E | I | Q | L | Nle | H | Q | hR | Aib | R | W | I | Q | Aib | Lys(C16)-# | | | |
| EU-224 | 199 | Ac5c | V | Aib | E | I | Q | L | Nle | H | Q | hR | Aib | R | W | I | Q | D | L | R | Aib | Lys(C8)-# |
| EU-225 | 200 | Ac5c | V | Aib | E | I | Q | L | Nle | H | Q | hR | Aib | R | W | I | Q | D | L | R | Aib | Lys(C12)-# |
| EU-226 | 201 | Ac5c | V | Aib | E | I | Q | L | Nle | H | Q | hR | Aib | R | W | I | Q | D | L | R | Aib | Lys(C16)-# |
| EU-227 | 202 | Ac5c | V | Aib | E | I | Q | L | Nle | H | Q | hR | Aib | R | F | I | Q | D | Lys(C12) | Aib-# | | |
| EU-228 | 203 | Ac5c | V | Aib | E | I | Q | L | Nle | H | Q | hR | Aib | R | F | I | Q | D | Lys(C12) | Aib-# | | |

Figure 2 (Continued)
Table 2 (Continued)

| | SEQ. ID. NO. | 1 | | | 5 | | | | | | 10 | | | | | 15 | | | | | 20 | |
|---|---|---|---|---|---|---|---|---|---|---|---|---|---|---|---|---|---|---|---|---|---|---|
| EU-229 | 204 | Ac5c | V | Aib | E | I | Q | L | Nle | H | Q | hR | Aib | R | W | I | Q | D | Lys(C16) | | | |
| EU-230 | 205 | Ac5c | V | Aib | E | I | Q | L | Nle | H | Q | hR | Aib | R | W | I | Q | Lys(C12) | Aib-# | | | |
| EU-231 | 206 | Ac5c | V | Aib | E | I | Q | L | Nle | H | Q | hR | A | R | W | I | Q | Lys(C12) | Aib-# | | | |
| EU-232 | 207 | Ac5c | V | Aib | E | I | Q | L | Nle | H | Q | hR | A | R | W | I | Q | Aib | Lys(C12) | | | |
| EU-233 | 208 | Ac5c | V | Aib | E | I | Q | L | Nle | H | Q | hR | A | R | F | I | Q | Lys(C12) | Aib-# | | | |
| EU-234 | 209 | Ac5c | V | Aib | E | I | Q | L | Nle | H | Q | hR | A | R | F | I | Q | Aib | Lys(C12) | | | |
| EU-235 | 210 | Ac5c | V | Aib | E | I | Q | L | Nle | H | Q | hR | Aib | R | W | I | Q | Lys(C12) | Aib-# | | | |
| EU-236 | 211 | Ac5c | V | Aib | E | I | Q | L | Nle | H | Q | hR | Aib | R | W | I | Q | Aib | Lys(C12) | | | |
| EU-237 | 212 | Ac5c | V | Aib | E | I | Q | L | Nle | H | Q | hR | Aib | R | F | I | Q | Lys(C12) | Aib-# | | | |
| EU-238 | 213 | Ac5c | V | Aib | E | H | Q | L | L | H | Q | hR | Aib | R | F | I | Q | Aib | Lys(C12) | | | |
| EU-239 | 214 | Ac5c | V | Aib | E | H | Q | L | L | H | Q | hR | A | R | F | I | Q | Lys(C12) | Aib-# | | | |
| EU-240 | 215 | Ac5c | V | Aib | E | H | Q | L | Nle | H | Q | hR | A | R | W | I | Q | Aib | Lys(C12) | | | |
| EU-241 | 216 | Ac5c | V | Aib | E | H | Q | L | Nle | H | Q | hR | A | R | W | I | Q | Lys(C12) | Aib-# | | | |
| EU-242 | 217 | Ac5c | V | Aib | E | H | Q | L | L | H | Q | hR | A | R | F | I | Q | Aib | Lys(C12) | | | |
| EU-243 | 218 | Ac5c | V | Aib | E | H | Q | L | L | H | Q | hR | A | R | W | I | Q | Lys(C12) | Aib-# | | | |
| EU-244 | 219 | Ac5c | V | Aib | E | H | Q | L | L | H | Q | hR | A | R | W | I | Q | Aib | Lys(C12) | | | |
| EU-245 | 220 | Ac5c | V | Aib | E | H | Q | L | L | H | Q | hR | A | R | F | I | Q | Lys(C12) | Aib-# | | | |
| EU-246 | 221 | Ac5c | V | Aib | E | H | Q | L | L | H | Q | hR | A | R | F | I | Q | Aib | Lys(C12) | | | |
| EU-247 | 222 | Ac5c | V | Aib | E | H | Q | L | Nle | H | Q | hR | Aib | R | W | I | Q | Lys(C12) | Aib-# | | | |
| EU-248 | 223 | Ac5c | V | Aib | E | H | Q | L | Nle | H | Q | hR | Aib | R | W | I | Q | Aib | Lys(C12) | | | |
| EU-249 | 224 | Ac5c | V | Aib | E | H | Q | L | Nle | H | Q | hR | Aib | R | F | I | Q | Lys(C12) | Aib-# | | | |
| EU-250 | 225 | Ac5c | V | Aib | E | H | Q | L | Nle | H | Q | hR | Aib | R | F | I | Q | Aib | Lys(C12) | | | |
| EU-251 | 226 | Ac5c | V | Aib | E | I | Q | L | Nle | H | Q | hR | A | R | W | I | Q | D | L | Lys(C12) | R | |
| EU-252 | 227 | Ac5c | V | Aib | E | I | Q | L | Nle | H | Q | hR | A | R | W | I | Q | D | L | Lys(C14) | R | |
| EU-253 | 228 | Ac5c | V | Aib | E | I | Q | L | Nle | H | Q | hR | A | R | W | I | Q | D | L | Lys(C16) | R | |
| EU-254 | 229 | Ac5c | V | Aib | E | I | Q | L | Nle | H | Q | hR | A | R | W | I | Q | D | Aib | Lys(C12) | R | |
| EU-255 | 230 | Ac5c | V | Aib | E | I | Q | L | Nle | H | Q | hR | A | R | W | I | Q | D | Aib | Lys(C14) | R | |
| EU-256 | 231 | Ac5c | V | Aib | E | I | Q | L | Nle | H | Q | hR | A | R | W | I | Q | D | Aib | Lys(C16) | R | |
| EU-257 | 232 | Ac5c | V | Aib | E | I | Q | L | Nle | H | Q | hR | A | R | W | I | Q | D | Ac5c | Lys(C12) | R | Aib-# |

Figure 2 (Continued)
Table 2 (Continued)

| | SEQ. ID. NO. | 1 | | | 5 | | | | | 10 | | | | | 15 | | | | | 20 | | |
|---|---|---|---|---|---|---|---|---|---|---|---|---|---|---|---|---|---|---|---|---|---|---|
| EU-258 | 233 | Ac5c | V | Aib | E | I | Q | L | Nle | H | Q | hR | A | R | W | I | Q | D | Ac5c | Lys(C14) | R | Aib-# |
| EU-259 | 234 | Ac5c | V | Aib | E | I | Q | L | Nle | H | Q | hR | A | R | W | I | Q | D | Ac5c | Lys(C16) | R | Aib-# |
| EU-260 | 235 | Ac5c | V | Aib | E | I | Q | L | Nle | H | Q | hR | A | R | W | I | Q | D | L | Lys(C12) | R | Ac5c-# |
| EU-261 | 236 | Ac5c | V | Aib | E | I | Q | L | Nle | H | Q | hR | A | R | W | I | Q | D | L | Lys(C14) | R | Ac5c-# |
| EU-262 | 237 | Ac5c | V | Aib | E | I | Q | L | Nle | H | Q | hR | A | R | W | I | Q | D | L | Lys(C16) | R | Ac5c-# |
| EU-263 | 238 | Ac5c | V | Aib | E | I | Q | L | Nle | H | Q | hR | Aib | R | W | I | Q | D | L | Lys(C14) | R | Ac5c-# |
| EU-264 | 239 | Ac5c | V | Aib | E | I | Q | L | Nle | H | Q | hR | Aib | R | W | I | Q | D | L | Lys(C16) | R | Ac5c-# |
| EU-265 | 240 | Ac5c | V | Aib | E | I | Q | L | Nle | H | Q | hR | Aib | R | W | I | Q | D | L | Lys(C12) | R | Ac5c-# |
| EU-266 | 241 | Ac5c | V | Aib | E | I | Q | L | Nle | H | Q | hR | Aib | R | W | I | Q | D | L | Lys(C14) | R | Aib-# |
| EU-267 | 242 | Ac5c | V | Aib | E | I | Q | L | Nle | H | Q | hR | Aib | R | W | I | Q | D | L | Lys(C16) | R | Aib-# |
| EU-268 | 243 | Ac5c | V | Aib | E | I | Q | L | Nle | H | Q | hR | Aib | R | W | I | Q | D | Aib | Lys(C12) | R | Aib-# |
| EU-269 | 244 | Ac5c | V | Aib | E | I | Q | L | Nle | H | Q | hR | Aib | R | W | I | Q | D | Aib | Lys(C14) | R | Aib-# |
| EU-270 | 245 | Ac5c | V | Aib | E | I | Q | L | Nle | H | Q | hR | Aib | R | W | I | Q | D | Aib | Lys(C16) | R | Aib-# |
| EU-271 | 246 | Ac5c | V | Aib | E | I | Q | L | Nle | H | Q | hR | Aib | R | W | I | Q | D | Ac5c | Lys(C12) | R | Aib-# |
| EU-272 | 247 | Ac5c | V | Aib | E | I | Q | L | Nle | H | Q | hR | Aib | R | W | I | Q | D | Ac5c | Lys(C14) | R | Aib-# |
| EU-273 | 248 | Ac5c | V | Aib | E | I | Q | L | Nle | H | Q | hR | Aib | R | W | I | Q | D | Ac5c | Lys(C16) | R | Aib-# |
| EU-274 | 249 | Ac5c | V | Aib | E | I | Q | L | L | H | Q | hR | A | R | W | I | Q | D | L | Lys(C12) | R | Aib-# |
| EU-275 | 250 | Ac5c | V | Aib | E | I | Q | L | L | H | Q | hR | A | R | W | I | Q | D | L | Lys(C14) | R | Aib-# |
| EU-276 | 251 | Ac5c | V | Aib | E | I | Q | L | L | H | Q | hR | A | R | W | I | Q | D | L | Lys(C16) | R | Aib-# |
| EU-277 | 252 | Ac5c | V | Aib | E | I | Q | L | L | H | Q | hR | Aib | R | W | I | Q | D | L | Lys(C12) | R | Aib-# |
| EU-278 | 253 | Ac5c | V | Aib | E | I | Q | L | L | H | Q | hR | Aib | R | W | I | Q | D | L | Lys(C14) | R | Aib-# |
| EU-279 | 254 | Ac5c | V | Aib | E | I | Q | L | L | H | Q | hR | Aib | R | W | I | N | D | L | Lys(C16) | R | Aib-# |
| EU-280 | 255 | Ac5c | V | Aib | E | I | Q | L | L | H | Q | hR | Aib | R | W | I | N | D | L | Lys(C12) | R | Aib-# |
| EU-281 | 256 | Ac5c | V | Aib | E | I | Q | L | L | H | Q | hR | Aib | R | W | I | N | D | L | Lys(C14) | R | Aib-# |
| EU-282 | 257 | Ac5c | V | Aib | E | I | Q | L | L | H | Q | hR | A | R | K* | I | Q | D | L | Lys(C16) | R | Aib-# |
| EU-283 | 258 | Ac5c | V | Aib | E | I | Q | L | Nle | H | Q | hR | Aib | R | W | I | Q | D | E* | Lys(C12) | R | Aib-# |
| EU-284 | 259 | Ac5c | V | Aib | E | I | Q | L | Nle | H | Q | hR | Aib | R | W | I | Q | D | K* | R | | |
| EU-286 | 260 | Ac5c | V | | E | I | Q | L | Nle | H | Q | hR | A | R | W | I | Q | Aib | Lys(C14) | Aib-# | | E*-F-L-Lys(C12)-Aib-# |

Figure 2 (Continued)
Table 2 (Continued)

| | SEQ. ID. NO. | 1 | | | | 5 | | | | | 10 | | | | | 15 | | | | | 20 |
|---|---|---|---|---|---|---|---|---|---|---|---|---|---|---|---|---|---|---|---|---|---|
| EU-287 | 261 | Ac5c | V | Aib | E | I | Q | L | Nle | H | Q | hR | A | R | W | — | Q | Aib | Lys(C16) | Aib-# | |
| EU-288 | 262 | Ac5c | V | Aib | E | I | Q | L | Nle | H | Q | hR | A | R | W | — | Q | Aib | Lys(C18) | Aib-# | |
| EU-289 | 263 | Ac5c | V | Aib | E | I | Q | L | Nle | H | Q | hR | A | R | F | — | Q | Aib | Lys(C12) | Aib-# | |
| EU-290 | 264 | Ac5c | V | Aib | E | I | Q | L | Nle | H | Q | hR | A | R | F | — | Q | Aib | Lys(C14) | Aib-# | |
| EU-291 | 265 | Ac5c | V | Aib | E | I | Q | L | Nle | H | Q | hR | A | R | F | — | Q | Aib | Lys(C16) | Aib-# | |
| EU-292 | 266 | Ac5c | V | Aib | E | I | Q | L | Nle | H | Q | hR | A | R | F | — | Q | Aib | Lys(C18) | Aib-# | |
| EU-293 | 267 | Ac5c | V | Aib | E | I | Q | L | Nle | H | Q | hR | A | R | F | — | Q | Aib | Lys(C12) | Aib-# | |
| EU-294 | 268 | Ac5c | V | Aib | E | I | Q | L | Nle | H | Q | hR | A | R | Nal2 | — | Q | Aib | Lys(C14) | Aib-# | |
| EU-295 | 269 | Ac5c | V | Aib | E | I | Q | L | Nle | H | Q | hR | A | R | Nal2 | — | Q | Aib | Lys(C16) | Aib-# | |
| EU-296 | 270 | Ac5c | V | Aib | E | I | Q | L | Nle | H | Q | hR | A | R | Nal2 | — | Q | Aib | Lys(C18) | Aib-# | |
| EU-297 | 271 | Ac5c | V | Aib | E | I | Q | L | Nle | H | Q | hR | E* | R | Nal2 | — | K* | Aib | Lys(C12) | Aib-# | |
| EU-298 | 272 | Ac5c | V | Aib | E | I | Q | L | Nle | H | Q | hR | E* | R | W | — | K* | Aib | Lys(C14) | Aib-# | |
| EU-299 | 273 | Ac5c | V | Aib | E | I | Q | L | Nle | H | Q | hR | E* | R | W | — | K* | Aib | Lys(C16) | Aib-# | |
| EU-900 | 274 | Ac5c | V | Aib | E | I | Q | L | Nle | H | Q | hR | E* | R | W | — | K* | Aib | Lys(C18) | Aib-# | |
| EU-901 | 275 | Ac5c | V | Aib | E | I | Q | L | Nle | H | Q | hR | A | R | W | — | Q | Aib | Lys(C12) | Aib | Aib-# |
| EU-902 | 276 | Ac5c | V | Aib | E | I | Q | L | Nle | H | Q | hR | A | R | W | — | Q | Aib | Lys(C14) | Aib | Aib-# |
| EU-903 | 277 | Ac5c | V | Aib | E | I | Q | L | Nle | H | Q | hR | A | R | W | — | Q | Aib | Lys(C16) | Aib | Aib-# |
| EU-904 | 278 | Ac5c | V | Aib | E | I | Q | L | Nle | H | Q | hR | A | R | W | — | Q | Aib | Lys(C18) | Aib | Aib-# |
| EU-905 | 279 | Ac5c | V | Aib | E | I | Q | L | Nle | H | Q | hR | E* | R | W | — | Q | Aib | Lys(C12) | Aib | Aib-# |
| EU-906 | 280 | Ac5c | V | Aib | E | I | Q | L | Nle | H | Q | hR | E* | R | W | — | K* | Aib | Lys(C14) | Aib | Aib-# |
| EU-907 | 281 | Ac5c | V | Aib | E | I | Q | L | Nle | H | Q | hR | E* | R | W | — | K* | Aib | Lys(C16) | Aib | Aib-# |
| EU-908 | 282 | Ac5c | V | Aib | E | I | Q | L | Nle | H | Q | hR | E* | R | W | — | K* | Aib | Lys(C18) | Aib | Aib-# | hR refers to homo-arginine

Top Panel

Bottom Panel

```
                                       llllllllllllllllllllll
       1         10           20            30
       .          .            .             .
PTH    SVSEIQLMHNLGKHLNSMERVEWLRKKLQDVHNF
PTHrP  AVSEHQLLHDKGKSIQDLRRRFFLHHLIAEIHTA
                 llllllllllllllllllllll
```

AGONIST EFFECT OF COMPOUND EU-232
AT THE HUMAN PTH1 RECEPTOR

EC50 = 2.4E-09 M
A = 0.0     D = 127.3

AGONIST EFFECT OF COMPOUND EU-285 AT THE HUMAN PTH1 RECEPTOR

EC50 = 2.9E-09 M
A = 0.0    D = 90.5

Figure 8
Table 3

| | SEQ. ID. NO. | 1 | | | | 5 | | | | | 10 | | | | 15 | | | | 20 |
|---|---|---|---|---|---|---|---|---|---|---|---|---|---|---|---|---|---|---|---|
| EU-A300 | 306 | H | Aib | Q | G | T | F | T | S | D | L | Lys(C8)-# | | | | | | | |
| EU-A301 | 307 | H | Aib | Q | G | T | F | T | S | D | L | Lys(C12)-# | | | | | | | |
| EU-A302 | 308 | H | Aib | Q | G | T | F | T | S | D | L | Lys(C16)-# | | | | | | | |
| EU-A303 | 309 | H | Aib | Q | G | T | F | T | S | D | Bip | Lys(C8)-# | | | | | | | |
| EU-A304 | 310 | H | Aib | Q | G | T | F | T | S | D | Bip | Lys(C12)-# | | | | | | | |
| EU-A305 | 311 | H | Aib | Q | G | T | F | T | S | D | Bip | Lys(C16)-# | | | | | | | |
| EU-A306 | 312 | H | Aib | Q | G | T | F | T | S | D | Nal(2) | Lys(C8)-# | | | | | | | |
| EU-A307 | 313 | H | Aib | Q | G | T | F | T | S | D | Nal(2) | Lys(C12)-# | | | | | | | |
| EU-A308 | 314 | H | Aib | Q | G | T | F | T | S | D | Nal(2) | Lys(C16)-# | | | | | | | |
| EU-A309 | 315 | H | Aib | Q | G | T | 2,6FF | T | S | D | Bip2Et4MeO | Lys(C8)-# | | | | | | | |
| EU-A310 | 316 | H | Aib | Q | G | T | 2,6FF | T | S | D | Bip2Et4MeO | Lys(C12)-# | | | | | | | |
| EU-A311 | 317 | H | Aib | Q | G | T | 2,6FF | T | S | D | Bip2Et4MeO | Lys(C16)-# | | | | | | | |
| EU-A312 | 318 | H | Aib | Q | G | T | F | T | S | D | L | S | K | Y | L | Lys(C8)-# | | | |
| EU-A313 | 319 | H | Aib | Q | G | T | F | T | S | D | L | S | K | Y | L | Lys(C12)-# | | | |
| EU-A314 | 320 | H | Aib | Q | G | T | F | T | S | D | L | S | K | Y | L | Lys(C16)-# | | | |
| EU-A315 | 321 | H | Aib | Q | G | T | F | T | S | D | Bip | S | K | Y | L | Lys(C8)-# | | | |
| EU-A316 | 322 | H | Aib | Q | G | T | F | T | S | D | Bip | S | K | Y | L | Lys(C12)-# | | | |
| EU-A317 | 323 | H | Aib | Q | G | T | F | T | S | D | Bip | S | K | Y | L | Lys(C16)-# | | | |
| EU-A318 | 324 | H | Aib | Q | G | T | F | T | S | D | Nal(2) | S | K | Y | L | Lys(C8)-# | | | |
| EU-A319 | 325 | H | Aib | Q | G | T | F | T | S | D | Nal(2) | S | K | Y | L | Lys(C12)-# | | | |
| EU-A320 | 326 | H | Aib | Q | G | T | F | T | S | D | Nal(2) | S | K | Y | L | Lys(C16)-# | | | |
| EU-A321 | 327 | H | Aib | Q | G | T | 2,6FF | T | S | D | Bip2Et4MeO | S | K | Y | L | Lys(C8)-# | | | |
| EU-A322 | 328 | H | Aib | Q | G | T | 2,6FF | T | S | D | Bip2Et4MeO | S | K | Y | L | Lys(C12)-# | | | |
| EU-A323 | 329 | H | Aib | Q | G | T | 2,6FF | T | S | D | Bip2Et4MeO | S | K | Y | L | Lys(C16)-# | | | |
| EU-A324 | 330 | H | Aib | Q | G | T | F | T | S | D | V | S | K | Y | L | D | G | R | Lys(C8)-# |
| EU-A325 | 331 | H | Aib | Q | G | T | F | T | S | D | L | S | K | Y | L | D | G | R | Lys(C8)-# |
| EU-A326 | 332 | H | Aib | Q | G | T | F | T | S | D | L | S | K | Y | L | D | G | R | Lys(C12)-# |
| EU-A327 | 333 | H | Aib | Q | G | T | F | T | S | D | L | S | K | Y | L | D | G | R | Lys(C16)-# |

Figure 8 (Continued)
Table 3 (Continued)

| | SEQ. ID. NO. | 1 | | Q | G | 5 | | T | S | D | 10 | | | | | 15 | G | R | | 20 | |
|---|---|---|---|---|---|---|---|---|---|---|---|---|---|---|---|---|---|---|---|---|---|
| EU-A328 | 334 | H | Aib | Q | G | T | F | T | S | D | Bip | S | K | Y | L | D | G | R | Lys(C8)-# | | |
| EU-A329 | 335 | H | Aib | Q | G | T | F | T | S | D | Bip | S | K | Y | L | D | G | R | Lys(C12)-# | | |
| EU-A330 | 336 | H | Aib | Q | G | T | F | T | S | D | Bip | S | K | Y | L | D | G | R | Lys(C16)-# | | |
| EU-A331 | 337 | H | Aib | Q | G | T | F | T | S | D | Nal(2) | S | K | Y | L | D | G | R | Lys(C8)-# | | |
| EU-A332 | 338 | H | Aib | Q | G | T | F | T | S | D | Nal(2) | S | K | Y | L | D | G | R | Lys(C12)-# | | |
| EU-A333 | 339 | H | Aib | Q | G | T | F | T | S | D | Nal(2) | S | K | Y | L | D | G | R | Lys(C16)-# | | |
| EU-A334 | 340 | H | Aib | Q | G | T | F | T | S | D | Bip2Et4MeO | S | K | Y | L | D | G | R | Lys(C8)-# | | |
| EU-A335 | 341 | H | Aib | Q | G | T | 2,6FF | T | S | D | Bip2Et4MeO | S | K | Y | L | D | G | R | Lys(C12)-# | | |
| EU-A336 | 342 | H | Aib | Q | G | T | 2,6FF | T | S | D | Bip2Et4MeO | S | K | Y | L | D | G | R | Lys(C16)-# | | |
| EU-A337 | 343 | H | Aib | Q | G | T | 2,6FF | T | S | D | L | Lys(C8)-# | | | | | | | | | |
| EU-A338 | 344 | H | Aib | Q | G | T | F | T | S | D | L | Lys(C12)-# | | | | | | | | | |
| EU-A339 | 345 | H | Aib | Q | G | T | F | T | S | D | L | Lys(C16)-# | | | | | | | | | |
| EU-A340 | 346 | H | Aib | Q | G | T | F | T | S | D | Bip | Lys(C8)-# | | | | | | | | | |
| EU-A341 | 347 | H | Aib | Q | G | T | F | T | S | D | Bip | Lys(C12)-# | | | | | | | | | |
| EU-A342 | 348 | H | Aib | Q | G | T | F | T | S | D | Bip | Lys(C16)-# | | | | | | | | | |
| EU-A343 | 349 | H | Aib | Q | G | T | F | T | S | D | Nal(2) | Lys(C8)-# | | | | | | | | | |
| EU-A344 | 350 | H | Aib | Q | G | T | F | T | S | D | Nal(2) | Lys(C12)-# | | | | | | | | | |
| EU-A345 | 351 | H | Aib | Q | G | T | F | T | S | D | Nal(2) | Lys(C16)-# | | | | | | | | | |
| EU-A346 | 352 | H | Aib | Q | G | T | 2,6FF | T | S | D | Bip2Et4MeO | Lys(C8)-# | | | | | | | | | |
| EU-A347 | 353 | H | Aib | Q | G | T | 2,6FF | T | S | D | Bip2Et4MeO | Lys(C12)-# | | | | | | | | | |
| EU-A348 | 354 | H | Aib | Q | G | T | 2,6FF | T | S | D | Bip2Et4MeO | Lys(C16)-# | | | | | | | | | |
| EU-A349 | 355 | H | Aib | Q | G | T | 2,6MeF | T | S | D | Bip | Lys(C8)-# | | | | | | | | | |
| EU-A350 | 356 | H | Aib | Q | G | T | 2,6MeF | T | S | D | Bip | Lys(C12)-# | | | | | | | | | |
| EU-A351 | 357 | H | Aib | Q | G | T | 2,6MeF | T | S | D | Bip | Lys(C16)-# | | | | | | | | | |
| EU-A352 | 358 | H | Aib | Q | G | T | MeF | T | S | D | L | S | K | Y | L | Lys(C8)-# | | | | | |
| EU-A353 | 359 | H | Aib | Q | G | T | MeF | T | S | D | L | S | K | Y | L | Lys(C12)-# | | | | | |
| EU-A354 | 360 | H | Aib | Q | G | T | MeF | T | S | D | L | S | K | Y | L | Lys(C16)-# | | | | | |
| EU-A355 | 361 | H | Aib | Q | G | T | MeF | T | S | D | Bip | S | K | Y | L | Lys(C8)-# | | | | | |
| EU-A356 | 362 | H | Aib | Q | G | T | MeF | T | S | D | Bip | S | K | Y | L | Lys(C12)-# | | | | | |

Figure 8 (Continued)
Table 3 (Continued)

| | SEQ. ID. NO. | 1 | | | | 5 | | | | | 10 | | | | | 15 | | | | | 20 |
|---|---|---|---|---|---|---|---|---|---|---|---|---|---|---|---|---|---|---|---|---|---|
| EU-A357 | 363 | H | Aib | Q | G | T | MeF | T | S | D | Bip | S | K | Y | L | Lys(C16)-# | | | | | |
| EU-A358 | 364 | H | Aib | Q | G | T | MeF | T | S | D | Nal(2) | S | K | Y | L | Lys(C8)-# | | | | | |
| EU-A359 | 365 | H | Aib | Q | G | T | MeF | T | S | D | Nal(2) | S | K | Y | L | Lys(C12)-# | | | | | |
| EU-A360 | 366 | H | Aib | Q | G | T | MeF | T | S | D | Nal(2) | S | K | Y | L | Lys(C16)-# | | | | | |
| EU-A361 | 367 | H | Aib | Q | G | T | MeF | T | S | D | Bip2Et4MeO | S | K | Y | L | Lys(C8)-# | | | | | |
| EU-A362 | 368 | H | Aib | Q | G | T | MeF | T | S | D | Bip2Et4MeO | S | K | Y | L | Lys(C12)-# | | | | | |
| EU-A363 | 369 | H | Aib | Q | G | T | MeF | T | S | D | Bip2Et4MeO | S | K | Y | L | Lys(C16)-# | | | | | |
| EU-A364 | 370 | H | Aib | Q | G | T | F | T | S | D | V | S | K | Y | L | E | S | Lys(C16)-# | | | |
| EU-A365 | 371 | H | Aib | Q | G | T | F | T | S | D | L | S | K | Y | L | E | S | Lys(C8)-# | | | |
| EU-A366 | 372 | H | Aib | Q | G | T | F | T | S | D | L | S | K | Y | L | E | S | Lys(C12)-# | | | |
| EU-A367 | 373 | H | Aib | Q | G | T | F | T | S | D | L | S | K | Y | L | E | S | Lys(C16)-# | | | |
| EU-A368 | 374 | H | Aib | Q | G | T | F | T | S | D | Bip | S | K | Y | L | E | S | Lys(C8)-# | | | |
| EU-A369 | 375 | H | Aib | Q | G | T | F | T | S | D | Bip | S | K | Y | L | E | S | Lys(C12)-# | | | |
| EU-A370 | 376 | H | Aib | Q | G | T | F | T | S | D | Bip | S | K | Y | L | E | S | Lys(C16)-# | | | |
| EU-A371 | 377 | H | Aib | Q | G | T | F | T | S | D | Nal(2) | S | K | Y | L | E | S | Lys(C8)-# | | | |
| EU-A372 | 378 | H | Aib | Q | G | T | F | T | S | D | Nal(2) | S | K | Y | L | E | S | Lys(C12)-# | | | |
| EU-A373 | 379 | H | Aib | Q | G | T | F | T | S | D | Nal(2) | S | K | Y | L | E | S | Lys(C16)-# | | | |
| EU-A374 | 380 | H | Aib | Q | G | T | 2,6FF | T | S | D | Bip2Et4MeO | S | K | Y | L | E | S | Lys(C8)-# | | | |
| EU-A375 | 381 | H | Aib | Q | G | T | 2,6FF | T | S | D | Bip2Et4MeO | S | K | Y | L | E | S | Lys(C12)-# | | | |
| EU-A376 | 382 | H | Aib | Q | G | T | 2,6FF | T | S | D | Bip2Et4MeO | S | K | Y | L | E | S | Lys(C16)-# | | | |
| EU-A377 | 383 | H | Aib | Q | G | T | F | T | S | D | Bip | S | K | Y | L | D | S | Lys(C8)-# | | | |
| EU-A378 | 384 | H | Aib | Q | G | T | F | T | S | D | Bip | S | K | Y | L | D | S | Lys(C12)-# | | | |
| EU-A379 | 385 | H | Aib | Q | G | T | F | T | S | D | Bip | S | K | Y | L | D | S | Lys(C16)-# | | | |
| EU-A380 | 386 | H | Aib | Q | G | T | F | T | S | D | Y | S | K | Y | L | D | R | Lys(C8)-# | | | |
| EU-A381 | 387 | H | Aib | Q | G | T | F | T | S | D | Y | S | K | Y | L | D | R | Lys(C12)-# | | | |
| EU-A382 | 388 | H | Aib | Q | G | T | F | T | S | D | Y | S | K | Y | L | D | R | Lys(C16)-# | | | |
| EU-A383 | 389 | H | Aib | Q | G | T | F | T | S | D | Y | S | K | Y | L | D | R | Lys(C8)-# | | | |
| EU-A384 | 390 | H | Aib | Q | G | T | F | T | S | D | Y | S | K | Y | L | D | R | Lys(C12)-# | | | |
| EU-A385 | 391 | H | Aib | Q | G | T | F | T | S | D | Y | S | K | Y | L | D | R | Lys(C16)-# | | | |
| EU-A386 | 392 | H | Aib | Q | G | T | F | T | S | D | Y | S | K | Y | L | D | Har | Lys(C12)-# | | | |

Figure 8 (Continued)
Table 3 (Continued)

| | SEQ. ID. NO. | 1 | | | 5 | | | | | 10 | | | | | 15 | | | | 20 |
|---|---|---|---|---|---|---|---|---|---|---|---|---|---|---|---|---|---|---|---|
| EU-A387 | 393 | H | Aib | Q | G | T | F | T | S | D | Bip | S | K | Y | L | E | S | Lys(C12)-# | | |
| EU-A388 | 394 | H | Aib | Q | G | T | MeF | T | S | D | Bip | S | K | Y | L | E | S | Lys(C12)-# | | |
| EU-A389 | 395 | H | Aib | Q | G | T | MeF | T | S | D | Bip | Aib | K | Y | L | E | S | Lys(C12)-# | | |
| EU-A390 | 396 | H | Aib | Q | G | T | MeF | T | S | D | Bip | S | K | Y | L | E | Aib | Lys(C12)-# | | |
| EU-A391 | 397 | H | Aib | Q | G | T | MeF | T | S | D | Y | S | K | Y | L | D | Aib | Lys(C12)-# | | |
| EU-A392 | 398 | H | Aib | Q | G | T | MeF | T | S | D | Y | Aib | K | Y | L | D | Aib | Lys(C12)-# | | |
| EU-A393 | 399 | H | Aib | Q | G | T | MeF | T | S | D | Y | Aib | Lys(C12)-# | Y | | | | | | |
| EU-A394 | 400 | H | Aib | Q | G | T | MeF | T | S | D | Nal(2) | Aib | Lys(C12)-# | Y | | | | | | |
| EU-A395 | 401 | H | Aib | Q | G | T | MeF | T | S | D | Y | S | K | Y | L | D | Aib | Lys(C12) | Aib-# | |
| EU-A396 | 402 | H | Aib | Q | G | T | MeF | T | S | D | Nal(2) | Aib | K | Y | L | D | Aib | Lys(C12) | Aib-# | |
| EU-A397 | 403 | H | Aib | Q | G | T | MeF | T | S | D | Y | Aib | K | Y | L | D | Aib | Lys(C12)-# | | |
| EU-A398 | 404 | H | Aib | Q | G | T | MeF | T | S | D | Y | Aib | K | Y | L | D | Aib | Lys(C12) | Aib-# | |
| EU-A399 | 405 | H | Aib | Q | G | T | MeF | T | S | D | Nal(2) | Aib | K | Y | L | E | Aib | Lys(C12)-# | | |
| EU-A400 | 406 | H | Aib | Q | G | T | MeF | T | S | D | Y | S | K | Y | L | D | R | Aib | Lys(C12) | Aib-# |
| EU-A401 | 407 | H | Aib | Q | G | T | MeF | T | S | D | Y | Aib | K | Y | L | D | R | Aib | Lys(C12) | Aib-# |
| EU-A402 | 408 | H | Aib | Q | G | T | MeF | T | S | D | Y | Aib | K | Y | L | D | R | Aib | Lys(C12) | Ac5c-# |
| EU-A403 | 409 | H | Aib | Q | G | T | MeF | T | S | D | Y | Aib | K | Y | L | E | R | Aib | Lys(C12)-# | Aib-# |
| EU-A404 | 410 | H | Aib | Q | G | T | F | T | S | D | Y | S | K | Y | Lys(C12)-# | D | Har | Aib | Lys(C8) | |
| EU-A405 | 411 | H | Aib | Q | G | T | F | T | S | D | Y | Aib | K | Y | Lys(C12) | -NHEt | Har | | Lys(C12) | |
| EU-A406 | 412 | H | Aib | Q | G | T | F | T | S | D | Y | Aib | K | Y | Lys(C12) | Aib-# | Har | | Lys(C12) | |
| EU-A407 | 413 | H | Aib | Q | G | T | MeF | T | S | D | Y | Aib | K | Y | Lys(C12) | Aib | | | Lys(C12)-# | |
| EU-A408 | 414 | H | Aib | Q | G | T | MeF | T | S | D | Y | Aib | K | Y | Lys(C12) | Ac5c-# | | | Lys(C8) | |
| EU-A409 | 415 | H | Aib | Q | G | T | MeF | T | S | D | Y | Aib | K | Y | L | | | | Lys(C12) | |
| EU-A410 | 416 | H | Aib | Q | G | T | MeF | T | S | D | Y | Aib | K | Y | L | | -NHEt | | Lys(C16) | |
| EU-A411 | 417 | H | Aib | Q | G | T | MeF | T | S | D | Y | Aib | K | Y | L | | | | | |
| EU-A412 | 418 | H | Aib | Q | G | T | MeF | T | S | D | Y | Aib | K | Y | L | D | Aib | Lys(C8)-# | | |
| EU-A413 | 419 | H | Aib | Q | G | T | MeF | T | S | D | Y | Aib | K | Y | L | D | Aib | Lys(C16)-# | | |
| EU-A414 | 420 | H | Aib | Q | G | T | F | T | S | D | Y | Aib | K | Y | L | D | Aib | Lys(C8)-# | | |
| EU-A415 | 421 | H | Aib | Q | G | T | F | T | S | D | Y | Aib | K | Y | L | D | Aib | Lys(C12)-# | | |
| EU-A416 | 422 | H | Aib | Q | G | T | F | T | S | D | Y | Aib | K | Y | L | D | Aib | Lys(C16)-# | | |

Figure 8 (Continued)

Table 3 (Continued)

| | SEQ. ID. NO. | 1 | | | | 5 | | | | | 10 | | | | 15 | | | | | | 20 |
|---|---|---|---|---|---|---|---|---|---|---|---|---|---|---|---|---|---|---|---|---|---|
| EU-A417 | 423 | H | Aib | Q | G | T | MeF | T | S | D | Y | S | K | Y | L | D | S | Aib | Lys(C8) | | Aib-# |
| EU-A418 | 424 | H | Aib | Q | G | T | MeF | T | S | D | Y | S | K | Y | L | D | S | Aib | Lys(C12) | | Aib-# |
| EU-A419 | 425 | H | Aib | Q | G | T | MeF | T | S | D | Y | S | K | Y | L | D | S | Aib | Lys(C16) | | Aib-# |
| EU-A420 | 426 | H | Aib | Q | G | T | MeF | T | S | D | Y | S | K | Y | L | D | S | Aib | Lys(C8) | | Ac5c-# |
| EU-A421 | 427 | H | Aib | Q | G | T | MeF | T | S | D | Y | S | K | Y | L | D | S | Aib | Lys(C12) | | Ac5c-# |
| EU-A422 | 428 | H | Aib | Q | G | T | MeF | T | S | D | Y | S | K | Y | L | D | S | Aib | Lys(C16) | | Ac5c-# |
| EU-A423 | 429 | H | Aib | Q | G | T | F | T | S | D | Y | S | K | Y | L | D | S | Aib | Lys(C8) | | Ac5c-# |
| EU-A424 | 430 | H | Aib | Q | G | T | F | T | S | D | Y | S | K | Y | L | D | S | Aib | Lys(C12) | | Ac5c-# |
| EU-A425 | 431 | H | Aib | Q | G | T | F | T | S | D | Y | S | K | Y | L | D | S | Aib | Lys(C16) | | Ac5c-# |

MeF means C-alphaMe-Phe; Har means homoArg; 2,6F-F means 2',6'-difluoro-Phe; Bip2Et4MeO means 2'-ethyl-4'-MeO-biphenylalanine.

Lys(C12) means N-epsilon-(1'-dodecyl beta-D-glucuronyl)-L-lysine and other C numbers mean the corresponding 1'-alkyl glucuronide.

# means amide C-terminus.

Figure 9
Table 4

| | SEQ. ID. NO. | 1 | | | | 5 | | | | | 10 | | | | | 15 | | | | | 20 | | | | | 25 |
|---|---|---|---|---|---|---|---|---|---|---|---|---|---|---|---|---|---|---|---|---|---|---|---|---|---|---|
| EU-A426 | 432 | H | Aib | Q | G | T | MeF | T | S | D | Y | S | K | Y | L | D | S | R | Aib | Lys(C8) | Aib-# | | | | |
| EU-A427 | 433 | H | Aib | Q | G | T | MeF | T | S | D | Y | S | K | Y | L | D | S | R | Aib | Lys(C12) | Aib-# | | | | |
| EU-A428 | 434 | H | Aib | Q | G | T | MeF | T | S | D | Y | S | K | Y | L | D | S | R | Aib | Lys(C16) | Aib-# | | | | |
| EU-A429 | 435 | H | Aib | Q | G | T | MeF | T | S | D | Y | S | K | Y | L | D | S | R | Aib | Lys(C8) | Ac5c-# | | | | |
| EU-A430 | 436 | H | Aib | Q | G | T | MeF | T | S | D | Y | S | K | Y | L | D | S | R | Aib | Lys(C12) | Ac5c-# | | | | |
| EU-A431 | 437 | H | Aib | Q | G | T | MeF | T | S | D | Y | S | K | Y | L | D | S | R | Aib | Lys(C16) | Ac5c-# | | | | |
| EU-A432 | 438 | H | Aib | Q | G | T | F | T | S | D | Y | S | K | Y | L | D | S | R | Aib | Lys(C8) | Aib-# | | | | |
| EU-A433 | 439 | H | Aib | Q | G | T | F | T | S | D | Y | S | K | Y | L | D | S | R | Aib | Lys(C12) | Aib-# | | | | |
| EU-A434 | 440 | H | Aib | Q | G | T | F | T | S | D | Y | S | K | Y | L | D | S | R | Aib | Lys(C16) | Aib-# | | | | |
| EU-A435 | 441 | H | Aib | Q | G | T | MeF | T | S | D | Y | S | K | Y | L | D | S | R | Aib | Ala | Q | Lys(C8) | F | Aib-# | |
| EU-A436 | 442 | H | Aib | Q | G | T | MeF | T | S | D | Y | S | K | Y | L | D | S | R | Aib | Ala | Q | Lys(C12) | F | Aib-# | |
| EU-A437 | 443 | H | Aib | Q | G | T | MeF | T | S | D | Y | S | K | Y | L | D | S | R | Aib | Ala | Q | Lys(C16) | F | Aib-# | |
| EU-A438 | 444 | H | Aib | Q | G | T | MeF | T | S | D | Y | S | K | Y | L | D | S | R | Aib | Ala | Q | Lys(C8) | F | Ac5c-# | |
| EU-A439 | 445 | H | Aib | Q | G | T | MeF | T | S | D | Y | S | K | Y | L | D | S | R | Aib | Ala | Q | Lys(C12) | F | Ac5c-# | |
| EU-A440 | 446 | H | Aib | Q | G | T | MeF | T | S | D | Y | S | K | Y | L | D | S | R | Aib | Ala | Q | Lys(C16) | F | Ac5c-# | |
| EU-A441 | 447 | H | Aib | Q | G | T | MeF | T | S | D | Y | S | K | Y | L | D | S | K* | R | Aib | Ala | Q | Lys(C8) | F | Aib-# | |
| EU-A442 | 448 | H | Aib | Q | G | T | MeF | T | S | D | Y | S | K | Y | L | D | K* | R | Aib | Ala | Q | Lys(C12) | F | Aib-# | |
| EU-A443 | 449 | H | Aib | Q | G | T | MeF | T | S | D | Y | S | K | Y | L | D | K* | R | Aib | Ala | Q | Lys(C16) | F | Aib-# | |
| EU-A444 | 450 | H | Aib | Q | G | T | MeF | T | S | D | Y | S | K | Y | L | D | K* | R | Aib | Ala | Q | Lys(C8) | F | Ac5c-# | |
| EU-A445 | 451 | H | Aib | Q | G | T | MeF | T | S | D | Y | S | E* | Y | L | D | K* | R | Aib | Ala | Q | Lys(C12) | F | Ac5c-# | |
| EU-A446 | 452 | H | Aib | Q | G | T | MeF | T | S | D | Y | S | E* | Y | L | D | K* | R | Aib | Ala | Q | Lys(C16) | F | Ac5c-# | |
| EU-A447 | 453 | H | Aib | Q | G | T | F | T | S | D | Y | S | E* | Y | L | D | K* | R | Aib | Ala | Q | Lys(C8) | F | Ac5c-# | |
| EU-A438 | 454 | H | Aib | Q | G | T | F | T | S | D | Y | S | E* | Y | L | D | K* | R | Aib | Ala | Q | Lys(C12) | F | Ac5c-# | |
| EU-A439 | 455 | H | Aib | Q | G | T | F | T | S | D | Y | S | E* | Y | L | D | K* | R | Aib | Ala | Q | Lys(C16) | F | Ac5c-# | |
| EU-A440 | 456 | H | Aib | Q | G | T | F | T | S | D | Y | S | E* | Y | L | D | K* | R | Aib | Ala | Q | Lys(C8) | F | Aib-# | |
| EU-A441 | 457 | H | Aib | Q | G | T | F | T | S | D | Y | S | E* | Y | L | D | K* | R | Aib | Ala | Q | Lys(C12) | F | Aib-# | |
| EU-A442 | 458 | H | Aib | Q | G | T | F | T | S | D | Y | S | E* | Y | L | D | K* | R | Aib | Ala | Q | Lys(C16) | F | Aib-# | |
| EU-A443 | 459 | H | Aib | Q | G | T | F | T | S | D | Y | S | E* | Y | L | D | K* | R | Aib | Ala | Q | Lys(C8) | F | Aib-# | |
| EU-A444 | 460 | H | Aib | Q | G | T | F | T | S | D | Y | S | E* | Y | L | D | K* | R | Aib | Ala | Q | Lys(C12) | F | Aib-# | |
| EU-A445 | 461 | H | Aib | Q | G | T | F | T | S | D | Y | S | E* | Y | L | D | E* | R | Aib | Ala | K* | Lys(C16) | F | Aib-# | |
| EU-A446 | 462 | H | Aib | Q | G | T | MeF | T | S | D | Y | S | K | Y | L | D | E* | R | Aib | Ala | Q | Lys(C8) | F | Aib-# | |

Figure 9 (Continued)
Table 4 (Continued)

| | SEQ. ID. NO. | 1 | | | | 5 | | | | | 10 | | | | | 15 | | | | | 20 | | | | | 25 |
|---|---|---|---|---|---|---|---|---|---|---|---|---|---|---|---|---|---|---|---|---|---|---|---|---|---|---|
| EU-A448 | 463 | H | Aib | Q | G | T | MeF | T | S | D | Y | S | K | Y | L | D | E* | R | Aib | Ala | K* | Lys(C12) | F | Aib-# | | |
| EU-A449 | 464 | H | Aib | Q | G | T | MeF | T | S | D | Y | S | K | Y | L | D | E* | R | Aib | Ala | K* | Lys(C16) | F | Aib-# | | |
| EU-A450 | 465 | H | Aib | Q | G | T | MeF | T | S | D | Y | S | K | Y | L | D | E* | R | Aib | Ala | K* | Lys(C8) | F | Ac5c-# | | |
| EU-A451 | 466 | H | Aib | Q | G | T | MeF | T | S | D | Y | S | K | Y | L | D | E* | R | Aib | Ala | K* | Lys(C12) | F | Ac5c-# | | |
| EU-A452 | 467 | H | Aib | Q | G | T | MeF | T | S | D | Y | S | K | Y | L | D | K* | R | Aib | Ala | K* | Lys(C16) | F | Ac5c-# | | |
| EU-A447 | 468 | H | Aib | Q | G | T | F | T | S | D | Y | S | K | Y | L | D | E* | R | Aib | Ala | K* | Lys(C8) | F | Aib-# | | |
| EU-A448 | 469 | H | Aib | Q | G | T | F | T | S | D | Y | S | K | Y | L | D | E* | R | Aib | Ala | K* | Lys(C12) | F | Aib-# | | |
| EU-A449 | 470 | H | Aib | Q | G | T | F | T | S | D | Y | S | K | Y | L | D | E* | R | Aib | Ala | K* | Lys(C16) | F | Aib-# | | |
| EU-A450 | 471 | H | Aib | Q | G | T | F | T | S | D | Y | S | K | Y | L | D | K* | R | Aib | Ala | K* | Lys(C8) | F | Ac5c-# | | |
| EU-A451 | 472 | H | Aib | Q | G | T | F | T | S | D | Y | S | K | Y | L | D | E* | R | Aib | Ala | K* | Lys(C12) | F | Ac5c-# | | |
| EU-A452 | 473 | H | Aib | Q | G | T | F | T | S | D | Y | S | K | Y | L | D | K* | R | Aib | Ala | K* | Lys(C16) | F | Ac5c-# | | |
| EU-A453 | 474 | H | Aib | Q | G | T | F | T | S | D | Y | S | K | Y | L | D | E* | R | Aib | Ala | K* | Lys(C12) | F | Aib-# | | |
| EU-A454 | 475 | H | Aib | Q | G | T | F | T | S | D | Y | S | K | Y | L | D | E* | Q | A | A | K* | Lys(C12) | F | Aib-# | | |
| EU-A455 | 476 | H | Aib | Q | G | T | F | T | S | D | Y | S | K | Y | L | D | K* | Q | A | A | K* | Lys(C16) | F | Aib-# | | |
| EU-A456 | 477 | H | Aib | Q | G | T | F | T | S | D | Y | S | K | Y | L | D | E* | R | A | A | K* | Lys(C12) | F | Ac5c-# | | |
| EU-A457 | 478 | H | Aib | Q | G | T | F | T | S | D | Y | S | K | Y | L | D | E* | R | A | A | K* | Lys(C16) | F | Ac5c-# | | |
| EU-A458 | 479 | H | Aib | Q | G | T | F | T | S | D | Y | S | K | Y | L | D | E* | R | A | A | K* | Lys(C12) | F | Ac5c-# | | |
| EU-A459 | 480 | H | Aib | Q | G | T | F | T | S | D | Y | S | K | Y | L | D | E* | Q | A | A | K* | Lys(C16) | F | Aib-# | | |
| EU-A460 | 481 | H | Aib | Q | G | T | F | T | S | D | Y | S | R | Y | L | D | E* | R | A | A | K* | Lys(C12) | F | Aib-# | | |
| EU-A461 | 482 | H | Aib | Q | G | T | F | T | S | D | Y | S | K | Y | L | D | S | Aib | Lys(C12) | Aib-# | | | | | | |
| EU-A462 | 483 | H | Aib | Q | G | T | F | T | S | D | Y | S | K | Y | L | D | S | R | Lys(C12) | Aib-# | | | | | | |
| EU-A463 | 484 | H | Aib | Q | G | T | F | T | S | D | Y | S | K | Y | L | D | S | R | Lys(C12) | Ac5c-# | | | | | | |
| EU-A464 | 485 | H | Aib | Q | G | T | F | T | S | D | Y | S | K | Y | L | D | S | R | Lys(C8) | Aib-# | | | | | | |
| EU-A465 | 486 | H | Aib | Q | G | T | F | T | S | D | Y | S | K | Y | L | D | S | R | Lys(C16) | Aib-# | | | | | | |
| EU-A466 | 487 | H | Aib | Q | G | T | F | T | S | D | Y | S | K | Y | L | D | S | Aib | Lys(C12) | Aib-# | | | | | | |
| EU-A467 | 488 | H | Aib | Q | G | T | F | T | S | D | Y | S | K | Y | L | D | S | Aib | Lys(C8) | Aib-# | | | | | | |
| EU-A468 | 489 | H | Aib | Q | G | T | F | T | S | D | Y | S | K | Y | L | D | S | Aib | Lys(C1) | Aib-# | | | | | | |
| EU-A469 | 490 | H | Aib | Q | G | T | F | T | S | D | Y | S | K | Y | L | D | E* | Aib | Lys(C16) | Aib-# | | | | | | |
| EU-A470 | 491 | H | Aib | Q | G | T | F | T | S | D | Y | S | K* | Y | L | D | E* | Aib | Lys(C16) | Aib-# | | | | | | |
| EU-A471 | 492 | H | Aib | Q | G | T | F | T | S | D | Y | S | K* | Y | L | D | E* | Aib | Lys(C12) | Aib-# | | | | | | |
| EU-A472 | 493 | H | Aib | Q | G | T | F | T | S | D | Y | S | K* | Y | L | D | E* | Aib | Lys(C8) | Aib-# | | | | | | |

Figure 9 (Continued)

Table 4 (Continued)

| | SEQ. ID. NO. | 1 | | | | 5 | | | | | 10 | | | | | 15 | | | | | 20 | 25 |
|---|---|---|---|---|---|---|---|---|---|---|---|---|---|---|---|---|---|---|---|---|---|---|
| EU-A473 | 494 | H | Aib | Q | G | T | F | T | S | D | Y | S | K* | Y | L | D | E* | R | Lys(C16) | Aib-# | | |
| EU-A474 | 495 | H | Aib | Q | G | T | F | T | S | D | Y | S | K* | Y | L | D | E* | R | Lys(C12) | Aib-# | | |
| EU-A475 | 496 | H | Aib | Q | G | T | F | T | S | D | Y | S | K* | Y | L | D | E* | R | Lys(C8) | Aib-# | | |
| EU-A476 | 497 | H | Aib | Q | G | T | F | T | S | D | Y | S | K* | Y | L | D | E* | R | Lys(C12) | Ac5c-# | | |
| EU-A477 | 498 | H | Aib | Q | G | T | F | T | S | D | Y | S | K | Y | L | D | R | Aib | Lys(C8) | # | | |
| EU-A478 | 499 | H | Aib | Q | G | T | F | T | S | D | Y | S | K | Y | L | D | R | Aib | Lys(C12) | # | | |
| EU-A479 | 500 | H | Aib | Q | G | T | F | T | S | D | Y | S | K | Y | L | D | R | Aib | Lys(C16) | # | | |
| EU-A480 | 501 | H | Aib | Q | G | T | F | T | S | D | Y | S | K | Y | L | D | S | R | Aib | Lys(C8) | # | |
| EU-A481 | 502 | H | Aib | Q | G | T | F | T | S | D | Y | S | K | Y | L | D | S | R | Aib | Lys(C12) | # | |
| EU-A482 | 503 | H | Aib | Q | G | T | F | T | S | D | Y | S | K | Y | L | D | S | R | Aib | Lys(C16) | # | |
| EU-A483 | 504 | H | Aib | Q | G | T | F | T | S | D | Y | S | K | Y | L | D | Aib | R | Aib | Lys(C8) | # | |
| EU-A484 | 505 | H | Aib | Q | G | T | F | T | S | D | Y | S | K | Y | L | D | Aib | R | Aib | Lys(C12) | # | |
| EU-A485 | 506 | H | Aib | Q | G | T | F | T | S | D | Y | S | K | Y | L | D | Aib | R | Aib | Lys(C16) | # | |
| EU-A486 | 507 | H | Aib | Q | G | T | F | T | S | D | V | S | S | Y | L | E | R | Aib | Lys(C8) | # | | |
| EU-A487 | 508 | H | Aib | Q | G | T | F | T | S | D | V | S | S | Y | L | E | R | Aib | Lys(C12) | # | | |
| EU-A488 | 509 | H | Aib | Q | G | T | F | T | S | D | V | S | S | Y | L | E | R | Aib | Lys(C16) | # | | |
| EU-A489 | 510 | H | Aib | Q | G | T | F | T | S | D | V | S | S | Y | L | E | Aib | R | Lys(C8) | # | | |
| EU-A490 | 511 | H | Aib | Q | G | T | F | T | S | D | V | S | S | Y | L | E | Aib | R | Lys(C12) | # | | |
| EU-A491 | 512 | H | Aib | Q | G | T | F | T | S | D | V | S | S | Y | L | E | Aib | R | Lys(C16) | # | | |
| EU-A492 | 513 | H | Aib | Q | G | T | F | T | S | D | Y | S | K | Y | L | D | hArg | Aib. | Lys(C8) | # | | |
| EU-A493 | 514 | H | Aib | Q | G | T | F | T | S | D | Y | S | K | Y | L | D | hArg | Aib | Lys(C12) | # | | |
| EU-A494 | 515 | H | Aib | Q | G | T | F | T | S | D | Y | S | K | Y | L | D | hArg | Aib | Lys(C16) | # | | |
| EU-A495 | 516 | H | Aib | Q | G | T | F | T | S | D | Y | S | K | Y | L | D | Aib | hArg | Lys(C8) | # | | |
| EU-A496 | 517 | H | Aib | Q | G | T | F | T | S | D | Y | S | K | Y | L | D | Aib | hArg | Lys(C12) | # | | |
| EU-A497 | 518 | H | Aib | Q | G | T | F | T | S | D | Y | S | K | Y | L | D | Aib | hArg | Lys(C16) | # | | |
| EU-A498 | 519 | H | Aib | Q | G | T | F | T | S | D | V | S | S | Y | L | E | hArg | Aib | Lys(C8) | # | | |
| EU-A499 | 520 | H | Aib | Q | G | T | F | T | S | D | V | S | S | Y | L | E | hArg | Aib | Lys(C12) | # | | |

Figure 9 (Continued)

Table 4 (Continued)

| SEQ. ID. NO. | | 1 | | | 5 | | | | | 10 | | | | 15 | | | | | 20 | | | 25 | | | | |
|---|---|---|---|---|---|---|---|---|---|---|---|---|---|---|---|---|---|---|---|---|---|---|---|---|---|---|
| EU-A501 | 521 | H | S | Q | G | T | F | T | S | D | Y | S | K | Y | L | D | S | R | R | A | Q | LysC12) | Aib | | | |
| EU-A502 | 522 | H | S | Q | G | T | F | T | S | D | Y | S | K | Y | L | D | S | R | R | A | LysC12) | Ab | # | | | |
| EU-A503 | 523 | H | S | Q | G | T | F | T | S | D | Y | S | K | Y | L | D | S | R | R | LysC12) | Ab | # | | | | |
| EU-A504 | 524 | H | S | Q | G | T | F | T | S | D | Y | S | K | Y | L | D | S | R | LysC12) | Ab | # | | | | | |
| EU-A505 | 525 | H | S | Q | G | T | F | T | S | D | Y | S | K | Y | L | D | S | LysC12) | Ab | # | | | | | | |
| EU-A506 | 526 | H | Aib | Q | G | T | F | T | S | D | Y | S | K | Y | L | D | LysC12) | Ab | # | | | | | | | |
| EU-A507 | 527 | H | S | Q | G | T | F | T | S | D | Y | S | K | Y | L | D | E* | Q | A | A | E | F | # | | | |
| EU-A509 | 528 | H | S | Q | G | T | F | T | S | D | Y | S | K | Y | L | D | S | R | A | K* | LysC12) | | I | | | |
| EU-A510 | 529 | H | S | Q | G | T | F | T | S | D | Y | S | K | Y | L | D | S | R | R | A | Q | LysC12) | | | | |
| EU-A511 | 530 | H | S | Q | G | T | F | T | S | D | Y | S | K | Y | L | D | S | R | R | LysC12) | # | | | | | |
| EU-A512 | 531 | H | S | Q | G | T | F | T | S | D | Y | S | K | Y | L | D | S | R | LysC12) | Ab | # | | | | | |
| EU-A513 | 532 | H | S | Q | G | T | F | T | S | D | Y | S | K | Y | L | D | LysC12) | # | | | | | | | | |
| EU-A514 | 533 | H | A | E | G | T | F | T | S | D | V | S | S | Y | L | E | G | Q | A | A | LysC12) | Aib | # | | | |
| EU-A515 | 534 | H | A | E | G | T | F | T | S | D | V | S | S | Y | L | E | G | Q | A | LysC12) | Ab | # | | | | |
| EU-A516 | 535 | H | A | E | G | T | F | T | S | D | V | S | S | Y | L | E | G | Q | LysC12) | Ab | # | | | | | |
| EU-A517 | 536 | H | A | E | G | T | F | T | S | D | V | S | S | Y | L | E | G | LysC12) | Ab | # | | | | | | |
| EU-A518 | 537 | H | A | E | G | T | F | T | S | D | V | S | S | Y | L | E | LysC12) | Ab | # | | | | | | | |
| EU-A519 | 538 | H | A | E | G | T | F | T | S | D | V | S | S | Y | L | Lys(C12) | Ab | # | | | | | | | | |
| EU-A520 | 539 | H | A | E | G | T | F | T | S | D | V | S | S | Y | L | | | | | | | | | W | L | M | N | T# |
| EU-A521 | 540 | H | Ab | Q | G | T | F | T | S | D | Y | S | K | Y | L | D | LysC12) | Aib | Aib | Aib | # | | | | | |
| EU-A522 | 541 | H | Ab | Q | G | T | F | T | S | D | Y | S | K | Y | L | D | LysC12) | Ac4c | Ac4c | # | | | | | | |
| EU-A523 | 542 | H | Ab | Q | G | T | F | T | S | D | Y | S | K | Y | L | D | LysC12) | R | R | # | | | | | | |
| EU-A524 | 543 | H | Ab | Q | G | T | F | T | S | D | Y | S | K | Y | L | D | LysC12) | Aib | Aib | # | | | | | | |
| EU-A525 | 544 | H | Ab | Q | G | T | F | T | S | D | Y | S | K | Y | L | D | LysC12) | R | R | # | | | | | | |
| EU-A526 | 545 | H | Ab | Q | G | T | F | T | S | D | Y | S | K | Y | L | D | LysC12) | hArg | Aib | # | | | | | | |
| EU-A527 | 546 | H | Ab | Q | G | T | F | T | S | D | Y | S | K | Y | L | D | S | hArg | Aib | Ab | # | | | | | |
| EU-A528 | 547 | H | Ab | Q | G | T | F | T | S | D | Y | S | K | Y | L | D | S | LysC12) | Ac4c | Ab | # | | | | | |
| EU-A529 | 548 | H | Ab | Q | G | T | F | T | S | D | Y | S | K | Y | L | D | S | LysC12) | R | Ab | # | | | | | |
| EU-A530 | 549 | H | Ab | Q | G | T | F | T | S | D | Y | S | K | Y | L | D | S | LysC12) | hArg | Ab | # | | | | | |
| EU-A531 | 550 | H | Ab | Q | G | T | F | T | S | D | Y | S | K | Y | L | D | S | R | LysC12) | Ab | # | | | | | |

Figure 9 (Continued)
Table 4 (Continued)

| | SEQ. ID. NO. | 1 | | | 5 | | | | | 10 | | | | | 15 | | | | | 20 | | 25 |
|---|---|---|---|---|---|---|---|---|---|---|---|---|---|---|---|---|---|---|---|---|---|---|
| EU-A532 | 551 | H | Aib | Q | G | T | F | T | S | D | Y | S | K | Y | L | D | S | R | Lys(C12) | Ac4c | # | |
| EU-A533 | 552 | H | Aib | Q | G | T | F | T | S | D | Y | S | K | Y | L | D | S | hArg | Lys(C12) | Aib | # | |
| EU-A534 | 553 | H | Aib | Q | G | T | F | T | S | D | Y | S | K | Y | L | D | Aib | R | Lys(C12) | Aib | # | |
| EU-A535 | 554 | H | Aib | Q | G | T | F | T | S | D | Y | S | K | Y | L | D | S | R | Lys(C14) | Aib | # | |
| EU-A536 | 555 | H | Aib | Q | G | T | F | T | S | D | Y | S | K | Y | L | D | S | R | Lys(C16) | Aib | # | |
| EU-A537 | 556 | H | Aib | Q | G | T | F | T | S | D | Y | S | K | Y | L | D | S | R | Lys(C18) | Aib | # | |
| EU-A538 | 557 | H | Aib | Q | G | T | F | T | S | D | Y | S | K | Y | L | D | Aib | R | Lys(C12) | Aib | # | |
| EU-A539 | 558 | H | Aib | Q | G | T | F | T | S | D | Y | S | K | Y | L | D | E* | Q | Lys(C12) | A | K* | # |
| EU-A540 | 559 | H | Aib | Q | G | T | F | T | S | D | Y | S | K | Y | L | D | E* | Q | Lys(C14) | A | K* | # |
| EU-A541 | 560 | H | Aib | Q | G | T | F | T | S | D | Y | S | K | Y | L | D | E* | Q | Lys(C16) | A | K* | # |
| EU-A542 | 561 | H | Aib | Q | G | T | F | T | S | D | Y | S | K | Y | L | D | E* | Q | Lys(C18) | A | K* | # |
| EU-A543 | 562 | H | Aib | Q | G | T | F | T | S | D | Y | S | K | Y | L | D | E* | Q | Lys(C20) | A | K* | # |
| EU-A544 | 563 | H | Aib | Q | G | T | F | T | S | D | Y | S | K | Y | L | D | S | R | Lys(C12) | Aib | Aib | # |
| EU-A545 | 564 | H | Aib | Q | G | T | F | T | S | D | Y | S | K | Y | L | D | S | R | Lys(C14) | Aib | Aib | # |
| EU-A546 | 565 | H | Aib | Q | G | T | F | T | S | D | Y | S | K | Y | L | D | S | R | Lys(C16) | Aib | Aib | # |
| EU-A547 | 566 | H | Aib | Q | G | T | F | T | S | D | Y | S | K | Y | L | D | S | R | Lys(C18) | Aib | Aib | # |
| EU-A548 | 567 | H | Aib | Q | G | T | F | T | S | D | Y | S | K | Y | L | D | S | R | Lys(C20) | Aib | Aib | # |
| EU-A549 | 568 | H | Aib | Q | G | T | F | T | S | D | Y | S | K | Y | L | D | S | R | Lys(C12) | Aib | | |
| EU-A550 | 569 | H | Aib | Q | G | T | F | T | S | D | Y | S | K | Y | L | D | Aib | Aib | Lys(C14) | # | | |
| EU-A551 | 570 | H | Aib | Q | G | T | F | T | S | D | Y | S | K | Y | L | D | Aib | Aib | Lys(C16) | # | | |
| EU-A552 | 571 | H | Aib | Q | G | T | F | T | S | D | Y | S | K | Y | L | D | Aib | Aib | Lys(C18) | # | | |
| EU-A553 | 572 | H | Aib | Q | G | T | F | T | S | D | Y | S | K | Y | L | D | Aib | Aib | Lys(C20) | # | | |
| EU-A554 | 573 | H | Aib | Q | G | T | F | T | S | D | Y | S | K | Y | L | D | S | Aib | Lys(C12) | Aib | Aib | # |
| EU-A555 | 574 | H | Aib | Q | G | T | F | T | S | D | Y | S | K | Y | L | D | S | Aib | Lys(C14) | Aib | Aib | # |
| EU-A556 | 575 | H | Aib | Q | G | T | F | T | S | D | Y | S | K | Y | L | D | S | Aib | Lys(C16) | Aib | Aib | # |
| EU-A557 | 576 | H | Aib | Q | G | T | F | T | S | D | Y | S | K | Y | L | D | S | Aib | Lys(C18) | Aib | Aib | # |
| EU-A558 | 577 | H | Aib | Q | G | T | F | T | S | D | Y | S | K | Y | L | D | S | Aib | Lys(C20) | Aib | Aib | # |
| EU-A559 | 578 | H | Aib | Q | G | T | F | T | S | D | Y | S | K* | Y | L | D | S | Aib | Lys(C22) | Aib | Aib | # |
| EU-A560 | 579 | H | Aib | Q | G | T | F | T | S | D | Y | S | K* | Y | L | D | S | R | Lys(C12) | Aib | | |
| EU-A561 | 580 | H | Aib | Q | G | T | F | T | S | D | Y | S | K* | Y | L | D | E* | R | Lys(C14) | Aib | # | |
| EU-A562 | 581 | H | Aib | Q | G | T | F | T | S | D | Y | S | K* | Y | L | D | E* | R | Lys(C16) | Aib | # | |
| EU-A563 | 582 | H | Aib | Q | G | T | F | T | S | D | Y | S | K* | Y | L | D | E* | R | Lys(C18) | Aib | # | |

Figure 9 (Continued)
Table 4 (Continued)

| | SEQ. ID. NO. | 1 | | | | 5 | | | | | 10 | | | | | 15 | | | | | 20 | | 25 |
|---|---|---|---|---|---|---|---|---|---|---|---|---|---|---|---|---|---|---|---|---|---|---|---|
| EU-A564 | 583 | H | Aib | Q | G | T | F | T | S | D | Y | S | K* | Y | L | D | E* | R | Lys(C20) | Ab | # | |
| EU-A565 | 584 | H | Aib | Q | G | T | F | T | S | D | Y | S | K* | Y | L | D | E* | Q | Lys(C12) | Ab | # | |
| EU-A566 | 585 | H | Aib | Q | G | T | F | T | S | D | Y | S | K* | Y | L | D | E* | Q | Lys(C14) | Ab | # | |
| EU-A567 | 586 | H | Aib | Q | G | T | F | T | S | D | Y | S | K* | Y | L | D | E* | Q | Lys(C16) | Ab | # | |
| EU-A568 | 587 | H | Aib | Q | G | T | F | T | S | D | Y | S | K* | Y | L | D | E* | Q | Lys(C18) | Ab | # | |
| EU-A569 | 588 | H | Aib | Q | G | T | F | T | S | D | Y | S | K* | Y | L | D | E* | Q | Lys(C20) | Ab | # | |
| EU-A570 | 589 | H | Aib | Q | G | T | F | T | S | D | Y | S | K* | Y | L | D | K* | R | Lys(C12) | Ab | Ab | # |
| EU-A571 | 590 | H | Aib | Q | G | T | F | T | S | D | Y | S | K* | Y | L | D | K* | R | Lys(C14) | Ab | Ab | # |
| EU-A572 | 591 | H | Aib | Q | G | T | F | T | S | D | Y | S | K* | Y | L | D | K* | R | Lys(C16) | Ab | Ab | # |
| EU-A573 | 592 | H | Aib | Q | G | T | F | T | S | D | Y | S | K* | Y | L | D | K* | R | Lys(C18) | Ab | Ab | # |
| EU-A574 | 593 | H | Aib | Q | G | T | F | T | S | D | Y | S | K* | Y | L | D | K* | R | Lys(C20) | Ab | Ab | # |
| EU-A575 | 594 | H | Aib | Q | G | T | F | T | S | D | Y | S | K* | Y | L | D | K* | hArg | Lys(C12) | Ab | Ab | # |
| EU-A576 | 595 | H | Aib | Q | G | T | F | T | S | D | Y | S | K* | Y | L | D | K* | hArg | Lys(C14) | Ab | Ab | # |
| EU-A577 | 596 | H | Aib | Q | G | T | F | T | S | D | Y | S | K* | Y | L | D | K* | hArg | Lys(C16) | Ab | Ab | # |
| EU-A578 | 597 | H | Aib | Q | G | T | F | T | S | D | Y | S | K* | Y | L | D | K* | hArg | Lys(C18) | Ab | Ab | # |
| EU-A579 | 598 | H | Aib | Q | G | T | F | T | S | D | Y | S | K* | Y | L | D | K* | hArg | Lys(C20) | Ab | Ab | # |
| EU-A580 | 599 | H | Aib | Q | G | T | F | T | S | D | Y | S | E* | Y | L | D | E* | R | Lys(C12) | Ab | Ab | # |
| EU-A581 | 600 | H | Aib | Q | G | T | F | T | S | D | Y | S | E* | Y | L | D | E* | R | Lys(C14) | Ab | Ab | # |
| EU-A582 | 601 | H | Ac4c | Q | G | T | F | T | S | D | Y | S | E* | Y | L | D | E* | R | Lys(C16) | Ab | Ab | # |
| EU-A583 | 602 | H | Ac4c | Q | G | T | F | T | S | D | Y | S | E* | Y | L | D | E* | R | Lys(C18) | Ab | Ab | # |
| EU-A584 | 603 | H | Ac4c | Q | G | T | F | T | S | D | Y | S | E* | Y | L | D | E* | R | Lys(C20) | Ab | Ab | # |
| EU-A585 | 604 | H | Ac4c | Q | G | T | F | T | S | D | Y | S | E* | Y | L | D | K* | hArg | Lys(C12) | Ab | Ab | # |
| EU-A586 | 605 | H | Ac4c | Q | G | T | F | T | S | D | Y | S | E* | Y | L | D | K* | hArg | Lys(C14) | Ab | Ab | # |
| EU-A587 | 606 | H | Ac4c | Q | G | T | F | T | S | D | Y | S | E* | Y | L | D | K* | hArg | Lys(C16) | Ab | Ab | # |
| EU-A588 | 607 | H | Ac4c | Q | G | T | F | T | S | D | Y | S | E* | Y | L | D | K* | hArg | Lys(C18) | Ab | Ab | # |
| EU-A589 | 608 | H | Ac4c | Q | G | T | F | T | S | D | Y | S | E* | Y | L | D | K* | hArg | Lys(C20) | Ab | Ab | # |
| EU-A590 | 609 | H | Ac4c | Q | G | T | F | T | S | D | Y | S | E* | Y | L | D | K* | R | Lys(C12) | Ab | Ab | # |
| EU-A591 | 610 | H | Ac4c | Q | G | T | F | T | S | D | Y | S | E* | Y | L | D | K* | R | Lys(C14) | Ab | Ab | # |
| EU-A592 | 611 | H | Ac4c | Q | G | T | F | T | S | D | Y | S | E* | Y | L | D | K* | R | Lys(C16) | Ab | Ab | # |
| EU-A593 | 612 | H | Ac4c | Q | G | T | F | T | S | D | Y | S | E* | Y | L | D | K* | R | Lys(C18) | Ab | Ab | # |
| EU-A594 | 613 | H | Ac4c | Q | G | T | F | T | S | D | Y | S | E* | Y | L | D | K* | R | Lys(C20) | Ab | Ab | # |
| EU-A595 | 614 | H | Ac4c | Q | G | T | F | T | S | D | Y | S | E* | Y | L | D | K* | hArg | Lys(C12) | Ab | Ab | # |

Figure 9 (Continued)

Table 4 (Continued)

| | SEQ. ID. NO. | 1 | | | | 5 | | | | | 10 | | | | | 15 | | | | | 20 | | | | | 25 |
|---|---|---|---|---|---|---|---|---|---|---|---|---|---|---|---|---|---|---|---|---|---|---|---|---|---|---|
| EU-A596 | 615 | H | Aoдc | Q | G | T | F | T | S | D | Y | S | E* | Y | L | D | L | K* | hArg | Lys(C14) | Aib | Aib | # | | | |
| EU-A597 | 616 | H | Aoдc | Q | G | T | F | T | S | D | Y | S | E* | Y | L | D | L | K* | hArg | Lys(C16) | Aib | Aib | # | | | |
| EU-A598 | 617 | H | Aoдc | Q | G | T | F | T | S | D | Y | S | E* | Y | L | D | L | K* | hArg | Lys(C18) | Aib | Aib | # | | | |
| EU-A599 | 618 | H | Aoдc | Q | G | T | F | T | S | D | Y | S | E* | Y | L | D | L | K* | hArg | Lys(C20) | Aib | Aib | # | | | |

MeF means C-alphaMe-Phe.

Lys(C12) means N-epsilon-(1'-dodecyl beta-D-glucuronyl)-L-lysine and other C numbers mean the corresponding 1'-alkyl glucoronide. The pair of amino acids E*, K* or K*, E* separated by 4 residues denotes a side chain lactam linkage formed between the side chain functional groups on these amino acids.

# means amide C-terminus.

| | SEQ ID. NO. | 1 | | | | 5 | | | | | 10 | | | | | 15 | | | | | 20 | | | | | 25 |
|---|---|---|---|---|---|---|---|---|---|---|---|---|---|---|---|---|---|---|---|---|---|---|---|---|---|---|
| EU-A700 | 646 | H | Aib | Q | G | T | F | T | S | D | Y | S | K | Y | L | D | Aib | R | Lys(C12) | Aib | | | | | | |
| EU-A701 | 647 | H | Aib | Q | G | T | F | T | S | D | Y | S | K | Y | L | D | Aib | R | Lys(C14) | Aib | # | | | | | |
| EU-A702 | 648 | H | Aib | Q | G | T | F | T | S | D | Y | S | K | Y | L | D | Aib | R | Lys(C16) | Aib | # | | | | | |
| EU-A703 | 649 | H | Aib | Q | G | T | F | T | S | D | Y | S | K | Y | L | D | Aib | R | Lys(C18) | Aib | # | | | | | |
| EU-A704 | 650 | H | Aib | Q | G | T | F | T | S | D | Y | S | K | Y | L | D | Aib | R | Lys(C20) | Aib | # | | | | | |
| EU-A705 | 651 | H | Aib | Q | G | T | F | T | S | D | Y | S | K | Y | L | D | Aib | hArg | Lys(C12) | Aib | # | | | | | |
| EU-A706 | 652 | H | Aib | Q | G | T | F | T | S | D | Y | S | K | Y | L | D | Aib | hArg | Lys(C14) | Aib | # | | | | | |

Figure 9 (Continued)
Table 4 (Continued)

| | SEQ ID NO. | 1 | | | | 5 | | | | | 10 | | | | | 15 | | | | | 20 | | | | | 25 |
|---|---|---|---|---|---|---|---|---|---|---|---|---|---|---|---|---|---|---|---|---|---|---|---|---|---|---|
| EU-A707 | 653 | H | Aib | Q | G | T | F | T | S | D | Y | S | K | Y | L | D | Aib | hArg | Lys(C16) | Aib | Aib | # | | | | |
| EU-A708 | 654 | H | Aib | Q | G | T | F | T | S | D | Y | S | K | Y | L | D | Aib | hArg | Lys(C18) | Aib | Aib | # | | | | |
| EU-A709 | 655 | H | Aib | Q | G | T | F | T | S | D | Y | S | K | Y | L | D | Aib | hArg | Lys(C20) | Aib | Aib | # | | | | |
| EU-A710 | 656 | H | Aib | Q | G | T | F | T | S | D | Y | S | K | Y | L | D | Aib | R | Lys(C12) | Aib | # | | | | | |
| EU-A711 | 657 | H | Aib | Q | G | T | F | T | S | D | Y | S | K | Y | L | D | Aib | R | Lys(C14) | Aib | # | | | | | |
| EU-A712 | 658 | H | Aib | Q | G | T | F | T | S | D | Y | S | K | Y | L | D | Aib | R | Lys(C16) | Aib | # | | | | | |
| EU-A713 | 659 | H | Aib | Q | G | T | F | T | S | D | Y | S | K | Y | L | D | Aib | R | Lys(C18) | Aib | # | | | | | |
| EU-A714 | 660 | H | Aib | Q | G | T | F | T | S | D | Y | S | K | Y | L | D | Aib | R | Lys(C20) | Aib | # | | | | | |
| EU-A715 | 661 | H | Aib | Q | G | T | F | T | S | D | Y | S | K | Y | L | D | Aib | hArg | Lys(C12) | Aib | # | | | | | |
| EU-A716 | 662 | H | Aib | Q | G | T | F | T | S | D | Y | S | K | Y | L | D | Aib | hArg | Lys(C14) | Aib | # | | | | | |
| EU-A717 | 663 | H | Aib | Q | G | T | F | T | S | D | Y | S | K | Y | L | D | Aib | hArg | Lys(C16) | Aib | # | | | | | |
| EU-A718 | 664 | H | Aib | Q | G | T | F | T | S | D | Y | S | K | Y | L | D | Aib | hArg | Lys(C18) | Aib | # | | | | | |
| EU-A719 | 665 | H | Aib | Q | G | T | F | T | S | D | Y | S | K | Y | L | D | Aib | hArg | Lys(C20) | Aib | # | | | | | |
| EU-A720 | 666 | H | Ac3c | Q | G | T | F | T | S | D | Y | S | K | Y | L | D | S | Arg | Lys(C12) | Aib | # | | | | | |
| EU-A721 | 667 | H | Aib | Q | G | T | F | T | S | D | Y | S | K | Y | L | D | S | hArg | Lys(C12) | # | | | | | | |
| EU-A722 | 668 | H | Aib | Q | G | T | F | T | S | D | Y | S | K | Y | L | D | Aib | Arg | Lys(C12) | # | | | | | | |
| EU-A723 | 669 | H | Aib | Q | G | T | F | T | S | D | Y | S | K | Y | L | D | Aib | hArg | Lys(C12) | # | | | | | | |

Figure 9 (Continued)
Table 4 (Continued)

| | SEQ ID. NO. | 1 | | | | | 5 | | | | 10 | | | | | | 15 | | | | | | | 20 | | | | | 25 | | | | | |
|---|---|---|---|---|---|---|---|---|---|---|---|---|---|---|---|---|---|---|---|---|---|---|---|---|---|---|---|---|---|---|---|---|---|
| EU-A724 | 670 | H | Aib | Q | G | T | T | F | T | S | D | Y | S | K | Y | L | D | Aib | hArg | Lys(C12) | # | | | | | | | | | | | |
| EU-A725 | 671 | H | Ac4c | Q | G | T | T | F | T | S | D | Y | S | K | Y | L | D | Aib | Arg | Lys(C12) | # | | | | | | | | | | | |
| EU-A726 | 672 | H | Ac4c | Q | G | T | T | F | T | S | D | Y | S | K | Y | L | D | Aib | Arg | Lys(C12) | Aib | | | | | | | | | | | |
| EU-A727 | 673 | H | Ac4c | Q | G | T | T | F | T | S | D | Y | S | K | Y | L | D | Aib | hArg | Lys(C12) | # | | | | | | | | | | | |
| EU-A728 | 674 | H | Ac4c | Q | G | T | T | F | T | S | D | Y | S | K | Y | L | D | Aib | hArg | Lys(C14) | # | | | | | | | | | | | |
| EU-A729 | 675 | H | Ac4c | Q | G | T | T | F | T | S | D | Y | S | K | Y | L | D | Aib | hArg | Lys(C16) | # | | | | | | | | | | | |
| EU-A730 | 676 | H | Ac4c | Q | G | T | T | F | T | S | D | Y | S | K | Y | L | D | Aib | hArg | Lys(C18) | # | | | | | | | | | | | |
| EU-A731 | 677 | H | Aib | Q | G | T | T | F | T | S | D | Y | S | K | Y | L | D | Aib | Arg | Lys(C12) | # | | | | | | | | | | | |
| EU-A732 | 678 | H | Ac4c | Q | G | T | T | F | T | S | D | Y | S | K | Y | L | D | S | hArg | Lys(C14) | # | | | | | | | | | | | |
| EU-A733 | 679 | H | Aib | Q | G | T | T | F | T | S | D | E* | S | K | E* | L | D | Aib | K* | Lys(C12) | # | | | | | | | | | | | |
| EU-A734 | 680 | H | Aib | Q | G | T | T | F | T | S | D | Y | S | K | Y | L | D | S | E* | Lys(C12) | A | K* | | | | | | | | | | |
| EU-A735 | 681 | H | Aib | Q | G | T | T | F | T | S | D | Y | S | K | Y | L | D | S | E* | Lys(C12) | A | R | K*,# | | | | | | | | | |
| EU-A736 | 682 | H | Aib | Q | G | T | T | F | T | S | D | Y | S | K | Y | L | D | S | E* | Lys(C14) | A | R | K*,# | | | | | | | | | |
| EU-A737 | 683 | H | Aib | Q | G | T | T | F | T | S | D | Y | S | K | Y | L | D | S | E* | Lys(C16) | A | R | K*,# | | | | | | | | | |
| EU-A738 | 684 | H | Aib | Q | G | T | T | F | T | S | D | Y | S | K | Y | L | D | S | E* | Lys(C18) | A | R | K*,# | | | | | | | | | |
| EU-A739 | 685 | H | Aib | Q | G | T | T | F | T | S | D | Y | S | K | Y | L | D | S | E* | Lys(C20) | A | R | K*,# | | | | | | | | | |
| EU-A740 | 686 | H | Aib | Q | G | T | T | F | T | S | D | Y | S | K | Y | L | D | S | E* | Lys(C12) | A | Q | K*,# | | | | | | | | | |

Figure 9 (Continued)
Table 4 (Continued)

| | SEQ ID. NO. | 1 | | | | 5 | | | | | 10 | | | | | 15 | | | | | 20 | | | 25 |
|---|---|---|---|---|---|---|---|---|---|---|---|---|---|---|---|---|---|---|---|---|---|---|---|---|
| EU-A741 | 687 | H | Aib | Q | G | T | F | T | S | D | Y | S | K | Y | L | D | S | | | | | | | |
| EU-A742 | 688 | H | Aib | Q | G | T | F | T | S | D | Y | S | K | Y | L | D | S | E* | Lys(C14) | A | Q | K*-# | | |
| EU-A743 | 689 | H | Aib | Q | G | T | F | T | S | D | Y | S | K | Y | L | D | S | E* | Lys(C16) | A | Q | K*-# | | |
| EU-A744 | 690 | H | Aib | Q | G | T | F | T | S | D | Y | S | K | Y | L | D | S | E* | Lys(C18) | A | Q | K*-# | | |
| EU-A745 | 691 | H | Aib | Q | G | T | F | T | S | D | Y | S | K | Y | L | D | S | E* | Lys(C20) | A | Q | K*-# | | |
| EU-A746 | 692 | H | Aib | Q | G | T | F | T | S | D | Y | S | K | Y | L | D | S | E* | Lys(C12) | V | R | | | |
| EU-A747 | 693 | H | Aib | Q | G | T | aMeF | T | S | D | Y | Lys(C8) | # | | | | | | | | | | | |
| EU-A748 | 694 | H | Aib | Q | G | T | aMeF | T | S | D | Y | Lys(C14) | # | | | | | | | | | | | |
| EU-A749 | 695 | H | Aib | Q | G | T | aMeF | T | S | D | Y | Lys(C16) | # | | | | | | | | | | | |
| EU-A750 | 696 | H | Aib | Q | G | T | F | T | S | D | Y | Lys(C20) | # | | | | | | | | | | | |
| EU-A751 | 697 | H | Aib | Q | G | T | aMeF | T | S | D | Y | Lys(C12) | # | | | | | | | | | | | |
| EU-A752 | 698 | H | Aib | Q | G | T | aMeF | T | S | D | Y | Lys(C18) | # | | | | | | | | | | | |
| EU-A753 | 699 | H | aMePro | Q | G | T | F | T | S | D | Y | Lys(C12) | # | | | | | | | | | | | |
| EU-A754 | 700 | H | aMePro | Q | G | T | aMeF | T | S | D | Y | Lys(C12) | # | | | | | | | | | | | |
| EU-A755 | 701 | H | aMePro | Q | G | T | aMeF | T | S | D | Bip | Lys(C12) | # | | | | | | | | | | | |
| EU-A756 | 702 | H | Aib | Q | G | T | F | T | S | D | Bip | Lys(C12) | # | | | | | | | | | | | |
| EU-A757 | 703 | H | Aib | Q | G | T | aMeF | T | S | D | Bip | Lys(C18) | # | | | | | | | | | | | |

Figure 9 (Continued)
Table 4 (Continued)

| | SEQ ID NO. | 1 | | | | 5 | | | | | 10 | | | | | 15 | | | | 20 | | | | | 25 | | | | |
|---|---|---|---|---|---|---|---|---|---|---|---|---|---|---|---|---|---|---|---|---|---|---|---|---|---|---|---|---|---|
| EU-A758 | 704 | H | aMePro | Q | G | T | aMeF | T | S | D | Y | Lys(C8) | # | | | | | | | | | | | | | | | | |
| EU-A759 | 705 | H | aMePro | Q | G | T | aMeF | T | S | D | Y | Lys(16) | # | | | | | | | | | | | | | | | | |
| EU-A760 | 706 | H | G | Q | G | T | F | T | S | D | Y | S | K | Y | L | D | E | Lys(C8) | A | A | R | E | F | I | A | W | L | L | N | T# |
| EU-A761 | 707 | H | G | Q | G | T | F | T | S | D | Y | S | K | Y | L | D | E | Lys(C12) | A | A | R | E | F | I | A | W | L | L | N | T# |
| EU-A762 | 708 | H | G | Q | G | T | F | T | S | D | Y | S | K | Y | L | D | E | Lys(C14) | A | A | R | E | F | I | A | W | L | L | N | T# |
| EU-A763 | 709 | H | G | Q | G | T | F | T | S | D | Y | S | K | Y | L | D | E | Lys(C16) | A | A | R | E | F | I | A | W | L | L | N | T# |
| EU-A764 | 710 | H | G | Q | G | T | F | T | S | D | Y | S | K | Y | L | D | E | Lys(C18) | A | A | R | E | F | I | A | W | L | L | N | T# |
| EU-A765 | 711 | H | G | Q | G | T | F | T | S | D | Y | S | K | Y | L | D | E | Lys(C20) | A | A | R | E | F | I | A | W | L | L | N | T# |
| EU-A766 | 712 | H | G | Q | G | T | F | T | S | D | Y | S | K | Y | L | D | E | Lys(C8) | A | A | K | E | F | I | A | W | L | L | N | T# |
| EU-A767 | 713 | H | G | Q | G | T | F | T | S | D | Y | S | K | Y | L | D | E | Lys(C14) | A | A | K | E | F | I | A | W | L | L | N | T# |
| EU-A768 | 714 | H | G | Q | G | T | F | T | S | D | Y | S | K | Y | L | D | E | Lys(C16) | A | A | K | E | F | I | A | W | L | L | N | T# |
| EU-A769 | 715 | H | G | Q | G | T | F | T | S | D | Y | S | K | Y | L | D | E | Lys(C20) | A | A | K | E | F | I | A | W | L | L | N | T# |
| EU-A770 | 716 | H | G | Q | G | T | F | T | S | D | Y | S | K | Y | L | D | E | K | A | A | K | E | F | I | A | W | L | L | N | T# |
| EU-A771 | 717 | H | G | Q | G | T | F | T | S | D | Y | S | K | Y | L | D | E | Lys(C12) | A | A | K | E | F | I | A | W | L | L | N | T# |
| EU-A772 | 718 | H | G | Q | G | T | F | T | S | D | Y | S | K | Y | L | D | E | Lys(C18) | A | A | K | E | F | I | A | W | L | L | N | T# |
| EU-A773 | 719 | H | Aib | Q | G | T | F | T | S | D | Y | S | K | Y | L | D | E | Lys(C18) | A | A | K | E | F | I | A | W | L | L | N | T# |
| EU-A774 | 720 | H | G | Q | G | T | F | T | S | D | Y | S | K | Y | L | D | E | R | A | R | K | D | F | V | Q | W | L | L | N | T# |

Figure 9 (Continued)
Table 4 (Continued)

| | SEQ ID NO. | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|---|
| EU-A775 | 721 | H | G | Q | G | T | F | T | S | D | Y | S | K | Y | L | D | E | R | R | A | Lys(C12) | D | F | V | Q | W | L | L | N | T# |
| EU-A776 | 722 | H | G | Q | G | T | F | T | S | D | Y | S | K | Y | L | D | E | R | R | A | Lys(C18) | D | F | V | Q | W | L | L | N | T# |
| EU-A777 | 723 | H | Aib | Q | G | T | F | T | S | D | Y | S | K | Y | L | D | E | R | R | A | Lys(C18) | D | F | V | Q | W | L | L | N | T# |
| EU-A778 | 724 | H | Aib | Q | G | T | F | T | S | D | Y | S | K | Y | L | D | E | R | R | A | Lys(C8) | D | F | V | Q | W | L | L | N | T# |
| EU-A779 | 725 | H | Aib | Q | G | T | F | T | S | D | Y | S | K | Y | L | D | E | R | R | A | Lys(C12) | D | F | V | Q | W | L | L | N | T# |
| EU-A780 | 726 | H | Aib | Q | G | T | F | T | S | D | Y | S | K | Y | L | D | E | R | R | A | Lys(C14) | D | F | V | Q | W | L | L | N | T# |
| EU-A781 | 727 | H | Aib | Q | G | T | F | T | S | D | Y | S | K | Y | L | D | E | R | R | A | Lys(C16) | D | F | V | Q | W | L | L | N | T# |
| EU-A782 | 728 | H | Aib | Q | G | T | F | T | S | D | Y | S | K | Y | L | D | E | R | R | A | Lys(C18) | D | F | V | Q | W | L | L | N | T# |
| EU-A783 | 729 | H | Aib | Q | G | T | F | T | S | D | Y | S | K | Y | L | D | E | R | R | A | Lys(C20) | D | F | V | Q | W | L | L | N | T# |
| EU-A784 | 730 | H | G | Q | G | T | F | T | S | D | Y | S | K | Y | L | D | E | R | R | A | Lys(C8) | D | F | V | Q | W | L | L | N | T# |
| EU-A785 | 731 | H | G | Q | G | T | F | T | S | D | Y | S | K | Y | L | D | E | R | R | A | Lys(C12) | D | F | V | Q | W | L | L | N | T# |
| EU-A786 | 732 | H | G | Q | G | T | F | T | S | D | Y | S | K | Y | L | D | E | R | R | A | Lys(C14) | D | F | V | Q | W | L | L | N | T# |
| EU-A787 | 733 | H | G | Q | G | T | F | T | S | D | Y | S | K | Y | L | D | E | R | R | A | Lys(C16) | D | F | V | Q | W | L | L | N | T# |
| EU-A788 | 734 | H | G | Q | G | T | F | T | S | D | Y | S | K | Y | L | D | E | R | R | A | Lys(C18) | D | F | V | Q | W | L | L | N | T# |
| EU-A789 | 735 | H | G | Q | G | T | F | T | S | D | Y | S | K | Y | L | D | E | R | R | A | Lys(C20) | D | F | V | Q | W | L | L | N | T# |
| EU-A790 | 736 | H | Aib | Q | G | T | F | T | S | D | Y | S | K | Y | L | D | E | Lys(C8) | A | A | K | E | F | I | A | W | L | L | N | T# |
| EU-A791 | 737 | H | Aib | Q | G | T | F | T | S | D | Y | S | K | Y | L | D | E | Lys(C12) | A | A | K | E | F | I | A | W | L | L | N | T# |

Figure 9 (Continued)
Table 4 (Continued)

| | SEQ ID. NO. | 1 | | | | 5 | | | | | 10 | | | | | 15 | | | | | | | 20 | | | | 25 | | | | |
|---|---|---|---|---|---|---|---|---|---|---|---|---|---|---|---|---|---|---|---|---|---|---|---|---|---|---|---|---|---|---|---|
| EU-A792 | 738 | H | Aib | Q | G | T | F | T | S | D | Y | S | K | Y | L | D | E | Lys(C14) | A | A | K | E | F | I | A | W | L | L | N | T# |
| EU-A793 | 739 | H | Aib | Q | G | T | F | T | S | D | Y | S | K | Y | L | D | E | Lys(C16) | A | A | K | E | F | I | A | W | L | L | N | T# |
| EU-A794 | 740 | H | Aib | Q | G | T | F | T | S | D | Y | S | K | Y | L | D | E | Lys(C18) | A | A | K | E | F | I | A | W | L | L | N | T# |
| EU-A795 | 741 | H | Aib | Q | G | T | F | T | S | D | Y | S | K | Y | L | D | E | Lys(C20) | A | A | K | E | F | I | A | W | L | L | N | T# |
| EU-A796 | 742 | H | Aib | Q | G | T | F | T | S | D | Y | S | K | Y | L | D | E* | Q | A | A | K* | E | F | I | Lys(C8) | W | L | M | N | T# |
| EU-A797 | 743 | H | Aib | Q | G | T | F | T | S | D | Y | S | K | Y | L | D | E* | Q | A | A | K* | E | F | I | Lys(C12) | W | L | M | N | T# |
| EU-A798 | 744 | H | Aib | Q | G | T | F | T | S | D | Y | S | K | Y | L | D | E* | Q | A | A | K* | E | F | I | Lys(C14) | W | L | M | N | T# |
| EU-A799 | 745 | H | Aib | Q | G | T | F | T | S | D | Y | S | K | Y | L | D | E* | Q | A | A | K* | E | F | I | Lys(C16) | W | L | M | N | T# |
| EU-A800 | 746 | H | Aib | Q | G | T | F | T | S | D | Y | S | K | Y | L | D | E* | Q | A | A | K* | E | F | I | Lys(C18) | W | L | M | N | T# |
| EU-A801 | 747 | H | Aib | Q | G | T | F | T | S | D | Y | S | K | Y | L | D | E* | Q | A | A | K* | E | F | I | Lys(C20) | W | L | M | N | T# |
| EU-A802 | 748 | H | Aib | Q | G | T | F | T | S | D | Y | S | K | Y | L | D | E* | Q | A | A | K* | E | F | I | Lys(C8) | W | L | L | N | T# |
| EU-A803 | 749 | H | Aib | Q | G | T | F | T | S | D | Y | S | K | Y | L | D | E* | Q | A | A | K* | E | F | I | Lys(C12) | W | L | L | N | T# |
| EU-A804 | 750 | H | Aib | Q | G | T | F | T | S | D | Y | S | K | Y | L | D | E* | Q | A | A | K* | E | F | I | Lys(C14) | W | L | L | N | T# |
| EU-A805 | 751 | H | Aib | Q | G | T | F | T | S | D | Y | S | K | Y | L | D | E* | Q | A | A | K* | E | F | I | Lys(C16) | W | L | L | N | T# |

Figure 9 (Continued)
Table 4 (Continued)

| | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|
| SEQ ID NO. | | | | | | | | | | | | | | | | | | | | | | | | | | | | | |
| EU-A806 752 | H | Aib | Q | G | T | F | T | S | D | Y | S | K | Y | L | D | E* | | | | K* | E | F | I | (  ) | W | L | L | N | T# |
| EU-A807 753 | H | Aib | Q | G | T | F | T | S | D | Y | S | K | Y | L | D | E* | | | | K* | E | F | I | Lys(C18) | W | L | L | N | T# |
| EU-A808 754 | H | G | Q | G | T | F | T | S | D | Y | S | K | Y | L | D | E | Q | A | A | R | E | F | I | Lys(C20) | W | L | L | N | T# |
| EU-A809 755 | H | G | Q | G | T | F | T | S | D | Y | S | K | Y | L | D | E | Q | A | A | R | E | F | I | Lys(C8) | W | L | L | N | T# |
| EU-A810 756 | H | G | Q | G | T | F | T | S | D | Y | S | K | Y | L | D | E | Q | A | A | R | E | F | I | Lys(C12) | W | L | L | N | T# |
| EU-A811 757 | H | G | Q | G | T | F | T | S | D | Y | S | K | Y | L | D | E | Q | A | A | R | E | F | I | Lys(C14) | W | L | L | N | T# |
| EU-A812 758 | H | G | Q | G | T | F | T | S | D | Y | S | K | Y | L | D | E | Q | A | A | R | E | F | I | Lys(C16) | W | L | L | N | T# |
| EU-A813 759 | H | G | Q | G | T | F | T | S | D | Y | S | K | Y | L | D | E | Q | A | A | R | E | F | I | Lys(C18) | W | L | L | N | T# |
| EU-A814 760 | H | Aib | Q | G | T | F | T | S | D | Y | S | K | Y | L | D | E | Q | A | A | R | E | F | I | Lys(C20) | W | L | L | N | T# |
| EU-A815 761 | H | Aib | Q | G | T | F | T | S | D | Y | S | K | Y | L | D | E | Lys(C8) | A | A | R | E | F | I | A | W | L | L | N | T# |
| EU-A816 762 | H | Aib | Q | G | T | F | T | S | D | Y | S | K | Y | L | D | E | Lys(C12) | A | A | R | E | F | I | A | W | L | L | N | T# |
| EU-A817 763 | H | Aib | Q | G | T | F | T | S | D | Y | S | K | Y | L | D | E | Lys(C14) | A | A | R | E | F | I | A | W | L | L | N | T# |
| EU-A818 764 | H | Aib | Q | G | T | F | T | S | D | Y | S | K | Y | L | D | E | Lys(C16) | A | A | R | E | F | I | A | W | L | L | N | T# |
| EU-A818 764 | H | Aib | Q | G | T | F | T | S | D | Y | S | K | Y | L | D | E | Lys(C18) | A | A | R | E | F | I | A | W | L | L | N | T# |

Figure 9 (Continued)

Table 4 (Continued)

| SEQ ID NO. | | 1 | | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|---|
| 765 | EU-A819 | H | Aib | Q | G | T | F | T | S | D | Y | S | K | Y | L | D | E | Lys(C20) | A | A | R | E | F | I | A | W | L | L | N | T# |
| 766 | EU-A820 | H | G | Q | G | T | F | T | S | D | Y | S | K | Y | L | D | E | R | R | A | Q | D | F | V | Lys(C8) | W | L | L | N | T# |
| 767 | EU-A821 | H | G | Q | G | T | F | T | S | D | Y | S | K | Y | L | D | E | R | R | A | Q | D | F | V | Lys(C12) | W | L | L | N | T# |
| 768 | EU-A822 | H | G | Q | G | T | F | T | S | D | Y | S | K | Y | L | D | E | R | R | A | Q | D | F | V | Lys(C14) | W | L | L | N | T# |
| 769 | EU-A823 | H | G | Q | G | T | F | T | S | D | Y | S | K | Y | L | D | E | R | R | A | Q | D | F | V | Lys(C16) | W | L | L | N | T# |
| 770 | EU-A824 | H | G | Q | G | T | F | T | S | D | Y | S | K | Y | L | D | E | R | R | A | Q | D | F | V | Lys(C18) | W | L | L | N | T# |
| 771 | EU-A825 | H | G | Q | G | T | F | T | S | D | Y | S | K | Y | L | D | E | R | R | A | Q | D | F | V | Lys(C20) | W | L | L | N | T# |
| 772 | EU-A826 | H | aMePro | Q | G | T | aMeF | T | S | D | Bip | Lys(C8) | # | | | | | | | | | | | | | | | | | |
| 773 | EU-A827 | H | aMePro | Q | G | T | aMeF | T | S | D | Bip | Lys(C12) | # | | | | | | | | | | | | | | | | | |
| 774 | EU-A828 | H | aMePro | Q | G | T | aMeF | T | S | D | Bip | Lys(C14) | # | | | | | | | | | | | | | | | | | |
| 775 | EU-A829 | H | aMePro | Q | G | T | aMeF | T | S | D | Bip | Lys(C16) | # | | | | | | | | | | | | | | | | | |
| 776 | EU-A830 | H | aMePro | Q | G | T | aMeF | T | S | D | Bip | Lys(C18) | # | | | | | | | | | | | | | | | | | |
| 777 | EU-A831 | H | aMePro | Q | G | T | aMeF | T | S | D | Bip | Lys(C20) | # | | | | | | | | | | | | | | | | | |
| 778 | EU-A832 | H | aMePro | Q | G | T | aMeF F | T | S | D | Bip | Lys(C8) | # | | | | | | | | | | | | | | | | | |
| 779 | EU-A833 | H | aMePro | Q | G | T | aMeF F | T | S | D | Bip | Lys(C12) | # | | | | | | | | | | | | | | | | | |

Figure 9 (Continued)
Table 4 (Continued)

| | SEQ ID NO. | | 1 | | | | 5 | | | | | | 10 | | | | | 15 | | | | | | | 20 | | | | | | 25 | | | | |
|---|---|---|---|---|---|---|---|---|---|---|---|---|---|---|---|---|---|---|---|---|---|---|---|---|---|---|---|---|---|---|---|---|---|---|---|
| EU-A834 | 780 | | H | aMePro | Q | G | T | aMeF | T | S | D | Bip | Lys(C14) | # | | | | | | | | | | | | | | | | | | | | | |
| EU-A835 | 781 | | H | aMePro | Q | G | T | aMeF | T | S | D | Bip | Lys(C16) | # | | | | | | | | | | | | | | | | | | | | | |
| EU-A836 | 782 | | H | aMePro | Q | G | T | aMeF | T | S | D | Bip | Lys(C18) | # | | | | | | | | | | | | | | | | | | | | | |
| EU-A837 | 783 | | H | aMePro | Q | G | T | aMeF | T | S | D | Bip | Lys(C20) | # | | | | | | | | | | | | | | | | | | | | | |
| EU-A838 | 784 | | H | Aib | Q | G | T | aMeF | T | S | D | Bip | Lys(C8) | # | | | | | | | | | | | | | | | | | | | | | |
| EU-A839 | 785 | | H | Aib | Q | G | T | aMeF | T | S | D | Bip | Lys(C12) | # | | | | | | | | | | | | | | | | | | | | | |
| EU-A840 | 786 | | H | Aib | Q | G | T | aMeF | T | S | D | Bip | Lys(C14) | # | | | | | | | | | | | | | | | | | | | | | |
| EU-A841 | 787 | | H | Aib | Q | G | T | aMeF | T | S | D | Bip | Lys(C16) | # | | | | | | | | | | | | | | | | | | | | | |
| EU-A842 | 788 | | H | Aib | Q | G | T | aMeF | T | S | D | Bip | Lys(C20) | # | | | | | | | | | | | | | | | | | | | | | |
| EU-A843 | 789 | | H | Aib | Q | G | T | aMeF | T | S | D | Bip | Lys(C8) | # | | | | | | | | | | | | | | | | | | | | | |
| EU-A844 | 790 | | H | Aib | Q | G | T | aMeF | T | S | D | Bip | Lys(C12) | # | | | | | | | | | | | | | | | | | | | | | |
| EU-A845 | 791 | | H | Aib | Q | G | T | aMeF | T | S | D | Bip | Lys(C14) | # | | | | | | | | | | | | | | | | | | | | | |
| EU-A846 | 792 | | H | Aib | Q | G | T | aMeF | T | S | D | Bip | Lys(C16) | # | | | | | | | | | | | | | | | | | | | | | |
| EU-A847 | 793 | | H | Aib | Q | G | T | aMeF | T | S | D | Bip | Lys(C18) | # | | | | | | | | | | | | | | | | | | | | | |
| EU-A848 | 794 | | H | Aib | Q | G | T | aMeF | T | S | D | Bip | Lys(C20) | # | | | | | | | | | | | | | | | | | | | | | |
| EU-A849 | 795 | | H | G | Q | G | T | F | T | S | D | Y | S | K | Y | L | D | A | Lys(C8) | A | A | R | E | F | I | A | W | L | L | N | T# |
| EU-A850 | 796 | | H | G | Q | G | T | F | T | S | D | Y | S | K | Y | L | D | A | Lys(C12) | A | A | R | E | F | I | A | W | L | L | N | T# |

Figure 9 (Continued)
Table 4 (Continued)

| | SEQ ID. NO. | 1 | | | | 5 | | | | | 10 | | | | | 15 | | | | | | 20 | | | | | 25 | | | | |
|---|---|---|---|---|---|---|---|---|---|---|---|---|---|---|---|---|---|---|---|---|---|---|---|---|---|---|---|---|---|---|---|
| EU-A851 | 797 | H | G | Q | G | T | F | T | S | D | Y | S | K | Y | L | D | A | Lys(C14) | A | A | R | E | F | I | A | W | L | L | N | T# |
| EU-A852 | 798 | H | G | Q | G | T | F | T | S | D | Y | S | K | Y | L | D | A | Lys(C16) | A | A | R | E | F | I | A | W | L | L | N | T# |
| EU-A853 | 799 | H | G | Q | G | T | F | T | S | D | Y | S | K | Y | L | D | A | Lys(C18) | A | A | R | E | F | I | A | W | L | L | N | T# |
| EU-A854 | 800 | H | G | Q | G | T | F | T | S | D | Y | S | K | Y | L | D | A | Lys(C20) | A | A | R | E | F | I | A | W | L | L | N | T# |
| EU-A855 | 801 | H | G | Q | G | T | F | T | S | D | Y | S | K | Y | L | D | A | Lys(C8) | A | A | K | E | F | I | A | W | L | L | N | T# |
| EU-A856 | 802 | H | G | Q | G | T | F | T | S | D | Y | S | K | Y | L | D | A | Lys(C12) | A | A | K | E | F | I | A | W | L | L | N | T# |
| EU-A857 | 803 | H | G | Q | G | T | F | T | S | D | Y | S | K | Y | L | D | A | Lys(C14) | A | A | K | E | F | I | A | W | L | L | N | T# |
| EU-A858 | 804 | H | G | Q | G | T | F | T | S | D | Y | S | K | Y | L | D | A | Lys(C16) | A | A | K | E | F | I | A | W | L | L | N | T# |
| EU-A859 | 805 | H | G | Q | G | T | F | T | S | D | Y | S | K | Y | L | D | A | Lys(C18) | A | A | K | E | F | I | A | W | L | L | N | T# |
| EU-A860 | 806 | H | G | Q | G | T | F | T | S | D | Y | S | K | Y | L | D | A | Lys(C20) | A | A | K | E | F | I | A | W | L | L | N | T# |
| EU-A861 | 807 | H | G | Q | G | T | F | T | S | D | Y | S | K | Y | L | D | Aib | Lys(C8) | A | A | K | E | F | I | A | W | L | L | N | T# |
| EU-A862 | 808 | H | G | Q | G | T | F | T | S | D | Y | S | K | Y | L | D | Aib | Lys(C12) | A | A | K | E | F | I | A | W | L | L | N | T# |
| EU-A863 | 809 | H | G | Q | G | T | F | T | S | D | Y | S | K | Y | L | D | Aib | Lys(C14) | A | A | K | E | F | I | A | W | L | L | N | T# |
| EU-A864 | 810 | H | G | Q | G | T | F | T | S | D | Y | S | K | Y | L | D | Aib | Lys(C16) | A | A | K | E | F | I | A | W | L | L | N | T# |
| EU-A865 | 811 | H | G | Q | G | T | F | T | S | D | Y | S | K | Y | L | D | Aib | Lys(C18) | A | A | K | E | F | I | A | W | L | L | N | T# |
| EU-A866 | 812 | H | G | Q | G | T | F | T | S | D | Y | S | K | Y | L | D | Aib | Lys(C20) | A | A | K | E | F | I | A | W | L | L | N | T# |
| EU-A867 | 813 | H | G | Q | G | T | F | T | S | D | Y | S | K | Y | L | D | Aib | Lys(C8) | A | A | R | E | F | I | A | W | L | L | N | T# |

Figure 9 (Continued)
Table 4 (Continued)

| SEQ ID. NO. | | 1 | | | 5 | | | | | | 10 | | | | | 15 | | | | | 20 | | | | | 25 | | | |
|---|---|---|---|---|---|---|---|---|---|---|---|---|---|---|---|---|---|---|---|---|---|---|---|---|---|---|---|---|---|
| 814 | EU-A868 | H | G | Q | G | T | F | T | S | D | Y | S | K | Y | L | D | Aib | Lys(C12) | A | A | R | E | F | I | A | W | L | L | N | T# |
| 815 | EU-A869 | H | G | Q | G | T | F | T | S | D | Y | S | K | Y | L | D | Aib | Lys(C14) | A | A | R | E | F | I | A | W | L | L | N | T# |
| 816 | EU-A870 | H | G | Q | G | T | F | T | S | D | Y | S | K | Y | L | D | Aib | Lys(C16) | A | A | R | E | F | I | A | W | L | L | N | T# |
| 817 | EU-A871 | H | G | Q | G | T | F | T | S | D | Y | S | K | Y | L | D | Aib | Lys(C18) | A | A | R | E | F | I | A | W | L | L | N | T# |
| 818 | EU-A872 | H | G | Q | G | T | F | T | S | D | Y | S | K | Y | L | D | Aib | Lys(C20) | A | A | R | E | F | I | A | W | L | L | N | T# |
| 819 | EU-A873 | H | Aib | Q | G | T | F | T | S | D | Y | S | K | Y | L | D | A | Lys(C8) | A | A | K | E | F | I | A | W | L | L | N | T# |
| 820 | EU-A874 | H | Aib | Q | G | T | F | T | S | D | Y | S | K | Y | L | D | A | Lys(C12) | A | A | K | E | F | I | A | W | L | L | N | T# |
| 821 | EU-A875 | H | Aib | Q | G | T | F | T | S | D | Y | S | K | Y | L | D | A | Lys(C14) | A | A | K | E | F | I | A | W | L | L | N | T# |
| 822 | EU-A876 | H | Aib | Q | G | T | F | T | S | D | Y | S | K | Y | L | D | A | Lys(C16) | A | A | K | E | F | I | A | W | L | L | N | T# |
| 823 | EU-A877 | H | Aib | Q | G | T | F | T | S | D | Y | S | K | Y | L | D | A | Lys(C18) | A | A | K | E | F | I | A | W | L | L | N | T# |
| 824 | EU-A878 | H | Aib | Q | G | T | F | T | S | D | Y | S | K | Y | L | D | A | Lys(C20) | A | A | K | E | F | I | A | W | L | L | N | T# |
| 825 | EU-A879 | H | Aib | Q | G | T | F | T | S | D | Y | S | K | Y | L | D | A | Lys(C8) | A | A | R | E | F | I | A | W | L | L | N | T# |
| 826 | EU-A880 | H | Aib | Q | G | T | F | T | S | D | Y | S | K | Y | L | D | A | Lys(C12) | A | A | R | E | F | I | A | W | L | L | N | T# |
| 827 | EU-A881 | H | Aib | Q | G | T | F | T | S | D | Y | S | K | Y | L | D | A | Lys(C14) | A | A | R | E | F | I | A | W | L | L | N | T# |
| 828 | EU-A882 | H | Aib | Q | G | T | F | T | S | D | Y | S | K | Y | L | D | A | Lys(C16) | A | A | R | E | F | I | A | W | L | L | N | T# |
| 829 | EU-A883 | H | Aib | Q | G | T | F | T | S | D | Y | S | K | Y | L | D | A | Lys(C18) | A | A | R | E | F | I | A | W | L | L | N | T# |
| 830 | EU-A884 | H | Aib | Q | G | T | F | T | S | D | Y | S | K | Y | L | D | A | Lys(C20) | A | A | R | E | F | I | A | W | L | L | N | T# |

Figure 9 (Continued)

Table 4 (Continued)

| | SEQ ID NO. | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|---|
| EU-A885 | 831 | H | G | Q | G | T | F | T | S | D | Y | S | K | Y | L | D | A | Q | A | A | R | E | F | I | Lys(C8) | W | L | L | N | T# |
| EU-A886 | 832 | H | G | Q | G | T | F | T | S | D | Y | S | K | Y | L | D | A | Q | A | A | R | E | F | I | Lys(C12) | W | L | L | N | T# |
| EU-A887 | 833 | H | G | Q | G | T | F | T | S | D | Y | S | K | Y | L | D | A | Q | A | A | R | E | F | I | Lys(C14) | W | L | L | N | T# |
| EU-A888 | 834 | H | G | Q | G | T | F | T | S | D | Y | S | K | Y | L | D | A | Q | A | A | R | E | F | I | Lys(C16) | W | L | L | N | T# |
| EU-A889 | 835 | H | G | Q | G | T | F | T | S | D | Y | S | K | Y | L | D | A | Q | A | A | R | E | F | I | Lys(C18) | W | L | L | N | T# |
| EU-A890 | 836 | H | G | Q | G | T | F | T | S | D | Y | S | K | Y | L | D | A | Q | A | A | R | E | F | I | Lys(C20) | W | L | L | N | T# |
| EU-A891 | 837 | H | G | Q | G | T | F | T | S | D | Y | S | K | Y | L | D | A | R | R | A | Lys(C8) | D | F | V | Q | W | L | L | N | T# |
| EU-A892 | 838 | H | G | Q | G | T | F | T | S | D | Y | S | K | Y | L | D | A | R | R | A | Lys(C12) | D | F | V | Q | W | L | L | N | T# |
| EU-A893 | 839 | H | G | Q | G | T | F | T | S | D | Y | S | K | Y | L | D | A | R | R | A | Lys(C14) | D | F | V | Q | W | L | L | N | T# |
| EU-A894 | 840 | H | G | Q | G | T | F | T | S | D | Y | S | K | Y | L | D | A | R | R | A | Lys(C16) | D | F | V | Q | W | L | L | N | T# |
| EU-A895 | 841 | H | G | Q | G | T | F | T | S | D | Y | S | K | Y | L | D | A | R | R | A | Lys(C18) | D | F | V | Q | W | L | L | N | T# |
| EU-A896 | 842 | H | G | Q | G | T | F | T | S | D | Y | S | K | Y | L | D | A | R | R | A | Lys(C20) | D | F | V | Q | W | L | L | N | T# |
| EU-A897 | 843 | H | Aib | Q | G | T | F | T | S | D | Y | S | K | Y | L | D | A | R | R | A | Lys(C18) | D | F | V | Q | W | L | L | N | T# |
| EU-A898 | 844 | H | Aib | Q | G | T | F | T | S | D | Y | S | K | Y | L | D | A | R | R | A | Lys(C8) | D | F | V | Q | W | L | L | N | T# |
| EU-A899 | 845 | H | Aib | Q | G | T | F | T | S | D | Y | S | K | Y | L | D | A | R | R | A | Lys(C14) | D | F | V | Q | W | L | L | N | T# |

Figure 9 (Continued)
Table 4 (Continued)

| SEQ ID. NO. | | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|
| 846 | EU-A900 | H | Aib | Q | G | T | F | T | S | D | Y | S | K | Y | L | D | A | R | R | A | Lys(C16) | D | F | V | Q | W | L | L | N | T# |
| 847 | EU-A901 | H | Aib | Q | G | T | F | T | S | D | Y | S | K | Y | L | D | A | R | R | A | Lys(C20) | D | F | V | Q | W | L | L | N | T# |
| 848 | EU-A902 | H | G | Q | G | T | F | T | S | D | Y | S | K | Y | L | D | A | R | R | A | Q | D | F | V | Lys(C8) | W | L | L | N | T# |
| 849 | EU-A903 | H | G | Q | G | T | F | T | S | D | Y | S | K | Y | L | D | A | R | R | A | Q | D | F | V | Lys(C12) | W | L | L | N | T# |
| 850 | EU-A904 | H | G | Q | G | T | F | T | S | D | Y | S | K | Y | L | D | A | R | R | A | Q | D | F | V | Lys(C14) | W | L | L | N | T# |
| 851 | EU-A905 | H | G | Q | G | T | F | T | S | D | Y | S | K | Y | L | D | A | R | R | A | Q | D | F | V | Lys(C16) | W | L | L | N | T# |
| 852 | EU-A906 | H | G | Q | G | T | F | T | S | D | Y | S | K | Y | L | D | A | R | R | A | Q | D | F | V | Lys(C18) | W | L | L | N | T# |
| 853 | EU-A907 | H | G | Q | G | T | F | T | S | D | Y | S | K | Y | L | D | A | R | R | A | Q | D | F | V | Lys(C20) | W | L | L | N | T# |
| 854 | EU-A908 | H | Aib | Q | G | T | F | T | S | D | Y | S | K | Y | L | D | Aib | Lys(C18) | A | A | K | E | F | I | A | W | L | L | N | T# |
| 855 | EU-A909 | H | Aib | Q | G | T | F | T | S | D | Y | S | K | Y | L | D | Aib | Lys(C8) | A | A | K | E | F | I | A | W | L | L | N | T# |
| 856 | EU-A910 | H | Aib | Q | G | T | F | T | S | D | Y | S | K | Y | L | D | Aib | Lys(C12) | A | A | K | E | F | I | A | W | L | L | N | T# |
| 857 | EU-A911 | H | Aib | Q | G | T | F | T | S | D | Y | S | K | Y | L | D | Aib | Lys(C14) | A | A | K | E | F | I | A | W | L | L | N | T# |
| 858 | EU-A912 | H | Aib | Q | G | T | F | T | S | D | Y | S | K | Y | L | D | Aib | Lys(C16) | A | A | K | E | F | I | A | W | L | L | N | T# |
| 859 | EU-A913 | H | Aib | Q | G | T | F | T | S | D | Y | S | K | Y | L | D | Aib | Lys(C18) | A | A | K | E | F | I | A | W | L | L | N | T# |
| 860 | EU-A914 | H | Aib | Q | G | T | F | T | S | D | Y | S | K | Y | L | D | Aib | Lys(C20) | A | A | K | E | F | I | A | W | L | L | N | T# |

Figure 9 (Continued)
Table 4 (Continued)

| | SEQ ID. NO. | 1 | | | | 5 | | | | | 10 | | | | | 15 | | | | | 20 | | | | | 25 | | | | | |
|---|---|---|---|---|---|---|---|---|---|---|---|---|---|---|---|---|---|---|---|---|---|---|---|---|---|---|---|---|---|---|---|
| EU-A915 | 861 | H | Aib | Q | G | T | F | T | S | D | Y | S | K | Y | L | D | Aib | Lys(C8) | | | R | | A | | E | F | I | A | W | L | L | N | T# |
| EU-A916 | 862 | H | Aib | Q | G | T | F | T | S | D | Y | S | K | Y | L | D | Aib | Lys(C12) | | | R | | A | | E | F | I | A | W | L | L | N | T# |
| EU-A917 | 863 | H | Aib | Q | G | T | F | T | S | D | Y | S | K | Y | L | D | Aib | Lys(C14) | | | R | | A | | E | F | I | A | W | L | L | N | T# |
| EU-A918 | 864 | H | Aib | Q | G | T | F | T | S | D | Y | S | K | Y | L | D | Aib | Lys(C16) | | | R | | A | | E | F | I | A | W | L | L | N | T# |
| EU-A919 | 865 | H | Aib | Q | G | T | F | T | S | D | Y | S | K | Y | L | D | Aib | Lys(C18) | | | R | | A | | E | F | I | A | W | L | L | N | T# |
| EU-A920 | 866 | H | Aib | Q | G | T | F | T | S | D | Y | S | K | Y | L | D | Aib | Lys(C20) | | | R | | A | | E | F | I | A | W | L | L | N | T# |
| EU-A921 | 867 | H | Aib | Q | G | T | F | T | S | D | Y | S | K | Y | L | D | Aib | R | A | R | Lys(C18) | D | F | V | Q | W | L | L | N | T# |
| EU-A922 | 868 | H | Aib | Q | G | T | F | T | S | D | Y | S | K | Y | L | D | Aib | R | A | R | Lys(C8) | D | F | V | Q | W | L | L | N | T# |
| EU-A923 | 869 | H | Aib | Q | G | T | F | T | S | D | Y | S | K | Y | L | D | Aib | R | A | R | Lys(C14) | D | F | V | Q | W | L | L | N | T# |
| EU-A924 | 870 | H | Aib | Q | G | T | F | T | S | D | Y | S | K | Y | L | D | Aib | R | A | R | Lys(C16) | D | F | V | Q | W | L | L | N | T# |
| EU-A925 | 871 | H | Aib | Q | G | T | F | T | S | D | Y | S | K | Y | L | D | Aib | R | A | R | Lys(C20) | D | F | V | Q | W | L | L | N | T# |
| EU-A926 | 872 | H | G | Q | G | T | F | T | S | D | Y | S | K | Y | L | D | Aib | R | A | R | Lys(C8) | D | F | V | Q | W | L | L | N | T# |
| EU-A927 | 873 | H | G | Q | G | T | F | T | S | D | Y | S | K | Y | L | D | Aib | R | A | R | Lys(C12) | D | F | V | Q | W | L | L | N | T# |
| EU-A928 | 874 | H | G | Q | G | T | F | T | S | D | Y | S | K | Y | L | D | Aib | R | A | R | Lys(C14) | D | F | V | Q | W | L | L | N | T# |
| EU-A929 | 875 | H | G | Q | G | T | F | T | S | D | Y | S | K | Y | L | D | Aib | R | A | R | Lys(C16) | D | F | V | Q | W | L | L | N | T# |
| EU-A930 | 876 | H | G | Q | G | T | F | T | S | D | Y | S | K | Y | L | D | Aib | R | A | R | Lys(C18) | D | F | V | Q | W | L | L | N | T# |
| EU-A931 | 877 | H | G | Q | G | T | F | T | S | D | Y | S | K | Y | L | D | Aib | R | A | R | Lys(C20) | D | F | V | Q | W | L | L | N | T# |

Figure 9 (Continued)
Table 4 (Continued)

| | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|
| SEQ ID. NO. | | | | | | | | | | | | | | | | | | | | | | | | | | | | | |
| 878 EU-A932 | H | G | Q | G | T | F | T | S | D | Y | S | K | Y | L | D | Aib | Q | A | A | R | E | F | I | Lys(C8) | W | L | L | N | T# |
| 879 EU-A933 | H | G | Q | G | T | F | T | S | D | Y | S | K | Y | L | D | Aib | Q | A | A | R | E | F | I | Lys(C12) | W | L | L | N | T# |
| 880 EU-A934 | H | G | Q | G | T | F | T | S | D | Y | S | K | Y | L | D | Aib | Q | A | A | R | E | F | I | Lys(C14) | W | L | L | N | T# |
| 881 EU-A935 | H | G | Q | G | T | F | T | S | D | Y | S | K | Y | L | D | Aib | Q | A | A | R | E | F | I | Lys(C16) | W | L | L | N | T# |
| 882 EU-A936 | H | G | Q | G | T | F | T | S | D | Y | S | K | Y | L | D | Aib | Q | A | A | R | E | F | I | Lys(C18) | W | L | L | N | T# |
| 883 EU-A937 | H | G | Q | G | T | F | T | S | D | Y | S | K | Y | L | D | Aib | Q | A | A | R | E | F | I | Lys(C20) | W | L | L | N | T# |
| 884 EU-A938 | H | G | Q | G | T | F | T | S | D | Y | S | K | Y | L | D | Aib | R | R | A | Q | D | F | V | Lys(C8) | W | L | L | N | T# |
| 885 EU-A939 | H | G | Q | G | T | F | T | S | D | Y | S | K | Y | L | D | Aib | R | R | A | Q | D | F | V | Lys(C12) | W | L | L | N | T# |
| 886 EU-A940 | H | G | Q | G | T | F | T | S | D | Y | S | K | Y | L | D | Aib | R | R | A | Q | D | F | V | Lys(C14) | W | L | L | N | T# |
| 887 EU-A941 | H | G | Q | G | T | F | T | S | D | Y | S | K | Y | L | D | Aib | R | R | A | Q | D | F | V | Lys(C16) | W | L | L | N | T# |
| 888 EU-A942 | H | G | Q | G | T | F | T | S | D | Y | S | K | Y | L | D | Aib | R | R | A | Q | D | F | V | Lys(C18) | W | L | L | N | T# |
| 889 EU-A943 | H | G | Q | G | T | F | T | S | D | Y | S | K | Y | L | D | Aib | R | R | A | Q | D | F | V | Lys(C20) | W | L | L | N | T# |

Figure 9 (Continued)
Table 4 (Continued)

| SEQ ID NO. | Name | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|
| 890 | EU-A944 | H | G | Q | G | T | F | T | S | D | Y | S | K | Y | L | D | E | Q | A | A | R | E | F | I | Lys(C8) | W | L | L | Q | T# |
| 891 | EU-A945 | H | G | Q | G | T | F | T | S | D | Y | S | K | Y | L | D | E | Q | A | A | R | E | F | I | Lys(C12) | W | L | L | Q | T# |
| 892 | EU-A946 | H | G | Q | G | T | F | T | S | D | Y | S | K | Y | L | D | E | Q | A | A | R | E | F | I | Lys(C14) | W | L | L | Q | T# |
| 893 | EU-A947 | H | G | Q | G | T | F | T | S | D | Y | S | K | Y | L | D | E | Q | A | A | R | E | F | I | Lys(C16) | W | L | L | Q | T# |
| 894 | EU-A948 | H | G | Q | G | T | F | T | S | D | Y | S | K | Y | L | D | E | Q | A | A | R | E | F | I | Lys(C18) | W | L | L | Q | T# |
| 895 | EU-A949 | H | G | Q | G | T | F | T | S | D | Y | S | K | Y | L | D | E | Q | A | A | R | E | F | I | Lys(C20) | W | L | L | Q | T# |
| 896 | EU-A950 | H | G | Q | G | T | F | T | S | D | Y | S | K | Y | L | D | E | Lys(C8) | A | A | R | E | F | I | A | W | L | L | Q | T# |
| 897 | EU-A951 | H | G | Q | G | T | F | T | S | D | Y | S | K | Y | L | D | E | Lys(C12) | A | A | R | E | F | I | A | W | L | L | Q | T# |
| 898 | EU-A952 | H | G | Q | G | T | F | T | S | D | Y | S | K | Y | L | D | E | Lys(C14) | A | A | R | E | F | I | A | W | L | L | Q | T# |
| 899 | EU-A953 | H | G | Q | G | T | F | T | S | D | Y | S | K | Y | L | D | E | Lys(C16) | A | A | R | E | F | I | A | W | L | L | Q | T# |
| 900 | EU-A954 | H | G | Q | G | T | F | T | S | D | Y | S | K | Y | L | D | E | Lys(C18) | A | A | R | E | F | I | A | W | L | L | Q | T# |
| 901 | EU-A955 | H | G | Q | G | T | F | T | S | D | Y | S | K | Y | L | D | E | Lys(C20) | A | A | R | E | F | I | A | W | L | L | Q | T# |
| 902 | EU-A956 | H | G | Q | G | T | F | T | S | D | Y | S | K | Y | L | D | E | Lys(C8) | A | A | K | E | F | I | A | W | L | L | Q | T# |
| 903 | EU-A957 | H | G | Q | G | T | F | T | S | D | Y | S | K | Y | L | D | E | Lys(C12) | A | A | K | E | F | I | A | W | L | L | Q | T# |
| 904 | EU-A958 | H | G | Q | G | T | F | T | S | D | Y | S | K | Y | L | D | E | Lys(C14) | A | A | K | E | F | I | A | W | L | L | Q | T# |

Figure 9 (Continued)
Table 4 (Continued)

| | SEQ ID NO. | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|---|
| EU-A959 | 905 | H | G | Q | G | T | F | T | S | D | Y | S | K | Y | L | D | E | Lys(C16) | A | A | K | E | F | I | A | W | L | L | Q | T# |
| EU-A960 | 906 | H | G | Q | G | T | F | T | S | D | Y | S | K | Y | L | D | E | Lys(C18) | A | A | K | E | F | I | A | W | L | L | Q | T# |
| EU-A961 | 907 | H | G | Q | G | T | F | T | S | D | Y | S | K | Y | L | D | E | Lys(C20) | A | A | K | E | F | I | A | W | L | L | Q | T# |
| EU-A962 | 908 | H | Aib | Q | G | T | F | T | S | D | Y | S | K | Y | L | D | E | Lys(C8) | A | A | K | E | F | I | A | W | L | L | Q | T# |
| EU-A963 | 909 | H | Aib | Q | G | T | F | T | S | D | Y | S | K | Y | L | D | E | Lys(C12) | A | A | K | E | F | I | A | W | L | L | Q | T# |
| EU-A964 | 910 | H | Aib | Q | G | T | F | T | S | D | Y | S | K | Y | L | D | E | Lys(C14) | A | A | K | E | F | I | A | W | L | L | Q | T# |
| EU-A965 | 911 | H | Aib | Q | G | T | F | T | S | D | Y | S | K | Y | L | D | E | Lys(C16) | A | A | K | E | F | I | A | W | L | L | Q | T# |
| EU-A966 | 912 | H | Aib | Q | G | T | F | T | S | D | Y | S | K | Y | L | D | E | Lys(C18) | A | A | K | E | F | I | A | W | L | L | Q | T# |
| EU-A967 | 913 | H | Aib | Q | G | T | F | T | S | D | Y | S | K | Y | L | D | E | Lys(C20) | A | A | K | E | F | I | A | W | L | L | Q | T# |
| EU-A968 | 914 | H | Aib | Q | G | T | F | T | S | D | Y | S | K | Y | L | D | Aib | Lys(C8) | A | A | R | E | F | I | A | W | L | L | Q | T# |
| EU-A969 | 915 | H | Aib | Q | G | T | F | T | S | D | Y | S | K | Y | L | D | Aib | Lys(C12) | A | A | R | E | F | I | A | W | L | L | Q | T# |
| EU-A970 | 916 | H | Aib | Q | G | T | F | T | S | D | Y | S | K | Y | L | D | Aib | Lys(C14) | A | A | R | E | F | I | A | W | L | L | Q | T# |
| EU-A971 | 917 | H | Aib | Q | G | T | F | T | S | D | Y | S | K | Y | L | D | Aib | Lys(C16) | A | A | R | E | F | I | A | W | L | L | Q | T# |
| EU-A972 | 918 | H | Aib | Q | G | T | F | T | S | D | Y | S | K | Y | L | D | Aib | Lys(C18) | A | A | R | E | F | I | A | W | L | L | Q | T# |
| EU-A973 | 919 | H | Aib | Q | G | T | F | T | S | D | Y | S | K | Y | L | D | E | Lys(C20) | A | A | R | E | F | I | A | W | L | L | Q | T# |
| EU-A974 | 920 | H | G | Q | G | T | F | T | S | D | Y | S | K | Y | L | D | E | R | A | R | Lys(C8) | D | F | V | Q | W | L | L | Q | T# |
| EU-A975 | 921 | H | G | Q | G | T | F | T | S | D | Y | S | K | Y | L | D | E | R | A | R | Lys(C12) | D | F | V | Q | W | L | L | Q | T# |

Figure 9 (Continued)
Table 4 (Continued)

| SEQ ID NO. | | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|
| 922 | EU-A976 | H | G | Q | G | T | F | T | S | D | Y | S | K | Y | L | D | E | R | R | A | Lys(C14) | D | F | V | Q | W | L | L | Q | T# |
| 923 | EU-A977 | H | G | Q | G | T | F | T | S | D | Y | S | K | Y | L | D | E | R | R | A | Lys(C16) | D | F | V | Q | W | L | L | Q | T# |
| 924 | EU-A978 | H | G | Q | G | T | F | T | S | D | Y | S | K | Y | L | D | E | R | R | A | Lys(C18) | D | F | V | Q | W | L | L | Q | T# |
| 925 | EU-A979 | H | G | Q | G | T | F | T | S | D | Y | S | K | Y | L | D | E | R | R | A | Lys(C20) | D | F | V | Q | W | L | L | Q | T# |
| 926 | EU-A980 | H | Aib | Q | G | T | F | T | S | D | Y | S | K | Y | L | D | E | R | R | A | Lys(C8) | D | F | V | Q | W | L | L | Q | T# |
| 927 | EU-A981 | H | Aib | Q | G | T | F | T | S | D | Y | S | K | Y | L | D | E | R | R | A | Lys(C12) | D | F | V | Q | W | L | L | Q | T# |
| 928 | EU-A982 | H | Aib | Q | G | T | F | T | S | D | Y | S | K | Y | L | D | E | R | R | A | Lys(C14) | D | F | V | Q | W | L | L | Q | T# |
| 929 | EU-A983 | H | Aib | Q | G | T | F | T | S | D | Y | S | K | Y | L | D | E | R | R | A | Lys(C16) | D | F | V | Q | W | L | L | Q | T# |
| 930 | EU-A984 | H | Aib | Q | G | T | F | T | S | D | Y | S | K | Y | L | D | E | R | R | A | Lys(C18) | D | F | V | Q | W | L | L | Q | T# |
| 931 | EU-A985 | H | Aib | Q | G | T | F | T | S | D | Y | S | K | Y | L | D | E | R | R | A | Lys(C20) | D | F | V | Q | W | L | L | Q | T# |
| 932 | EU-A986 | H | Aib | Q | G | T | F | T | S | D | Y | S | K | Y | L | D | E* | Q | A | A | K* | E | F | – | Lys(C8) | W | L | M | Q | T# |
| 933 | EU-A987 | H | Aib | Q | G | T | F | T | S | D | Y | S | K | Y | L | D | E* | Q | A | A | K* | E | F | – | Lys(C12) | W | L | M | Q | T# |
| 934 | EU-A988 | H | Aib | Q | G | T | F | T | S | D | Y | S | K | Y | L | D | E* | Q | A | A | K* | E | F | – | Lys(C14) | W | L | M | Q | T# |
| 935 | EU-A989 | H | Aib | Q | G | T | F | T | S | D | Y | S | K | Y | L | D | E* | Q | A | A | K* | E | F | – | Lys(C16) | W | L | M | Q | T# |
| 936 | EU-A990 | H | Aib | Q | G | T | F | T | S | D | Y | S | K | Y | L | D | E* | Q | A | A | K* | E | F | – | Lys(C18) | W | L | M | Q | T# |

Figure 9 (Continued)
Table 4 (Continued)

| SEQ ID. NO. | 1 |  |  | 5 |  |  |  |  | 10 |  |  |  |  |  | 15 |  |  |  |  |  | 20 |  |  |  | 25 |  |  |  |  |  |
|---|---|---|---|---|---|---|---|---|---|---|---|---|---|---|---|---|---|---|---|---|---|---|---|---|---|---|---|---|---|---|
|  | H | Aib | Q | G | T | F | T | S | D | Y | S | K | Y | L | D | E* | Q | A | A | K* | E | F | I | Lys(C20) | W | L | L | M | Q | T# |
| 937 EU-A991 | H | Aib | Q | G | T | F | T | S | D | Y | S | K | Y | L | D | E* | Q | A | A | K* | E | F | I | Lys(C20) | W | L | L | M | Q | T# |
| 938 EU-A992 | H | Aib | Q | G | T | F | T | S | D | Y | S | K | Y | L | D | E* | Q | A | A | K* | E | F | I | Lys(C8) | W | L | L | L | Q | T# |
| 939 EU-A993 | H | Aib | Q | G | T | F | T | S | D | Y | S | K | Y | L | D | E* | Q | A | A | K* | E | F | I | Lys(C12) | W | L | L | L | Q | T# |
| 940 EU-A994 | H | Aib | Q | G | T | F | T | S | D | Y | S | K | Y | L | D | E* | Q | A | A | K* | E | F | I | Lys(C14) | W | L | L | L | Q | T# |
| 941 EU-A995 | H | Aib | Q | G | T | F | T | S | D | Y | S | K | Y | L | D | E* | Q | A | A | K* | E | F | I | Lys(C16) | W | L | L | L | Q | T# |
| 942 EU-A996 | H | Aib | Q | G | T | F | T | S | D | Y | S | K | Y | L | D | E* | Q | A | A | K* | E | F | I | Lys(C18) | W | L | L | L | Q | T# |
| 943 EU-A997 | H | Aib | Q | G | T | F | T | S | D | Y | S | K | Y | L | D | E* | Q | A | A | K* | E | F | I | Lys(C20) | W | L | L | L | Q | T# |
| 944 EU-A998 | H | Aib | Q | G | T | F | T | S | D | Y | S | K | Y | L | D | E* | Q | A | A | K* | E | F | I | Lys(M8) | W | L | L | L | Q | T# |
| 945 EU-A999 | H | Aib | Q | G | T | F | T | S | D | Y | S | K | Y | L | D | E* | Q | A | A | K* | E | F | I | Lys(M12) | W | L | L | L | Q | T# |
| 946 EU-A1000 | H | Aib | Q | G | T | F | T | S | D | Y | S | K | Y | L | D | E* | Q | A | A | K* | E | F | I | Lys(M14) | W | L | L | L | Q | T# |
| 947 EU-A1001 | H | Aib | Q | G | T | F | T | S | D | Y | S | K | Y | L | D | E* | Q | A | A | K* | E | F | I | Lys(M16) | W | L | L | L | Q | T# |
| 948 EU-A1002 | H | Aib | Q | G | T | F | T | S | D | Y | S | K | Y | L | D | E* | Q | A | A | K* | E | F | I | Lys(M18) | W | L | L | L | Q | T# |

Figure 9 (Continued)
Table 4 (Continued)

| | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|
| SEQ ID. NO. | | | | | | | | | | | | | | | | | | | | | | | | | | | | | |
| 949 EU-A1003 | H | Aib | Q | G | T | F | T | S | D | Y | S | K | Y | L | D | E* | Q | A | A | K* | E | F | I | | W | L | L | Q | T# |
| 950 EU-A1004 | H | G | Q | G | T | F | T | S | D | Y | S | K | Y | L | D | E | Q | A | A | R | E | F | I | Lys(M20) | W | L | L | Q | T# |
| 951 EU-A1005 | H | G | Q | G | T | F | T | S | D | Y | S | K | Y | L | D | E | Q | A | A | R | E | F | I | Lys(M8) | W | L | L | Q | T# |
| 952 EU-A1006 | H | G | Q | G | T | F | T | S | D | Y | S | K | Y | L | D | E | Q | A | A | R | E | F | I | Lys(M12) | W | L | L | Q | T# |
| 953 EU-A1007 | H | G | Q | G | T | F | T | S | D | Y | S | K | Y | L | D | E | Q | A | A | R | E | F | I | Lys(M14) | W | L | L | Q | T# |
| 954 EU-A1008 | H | G | Q | G | T | F | T | S | D | Y | S | K | Y | L | D | E | Q | A | A | R | E | F | I | Lys(M16) | W | L | L | Q | T# |
| 955 EU-A1009 | H | G | Q | G | T | F | T | S | D | Y | S | K | Y | L | D | E | Q | A | A | R | E | F | I | Lys(M18) | W | L | L | Q | T# |
| 956 EU-A1010 | H | G | Q | G | T | F | T | S | D | Y | S | K | Y | L | D | E | Q | A | A | K | E | F | I | Lys(M20) | W | L | L | N | T# |
| 957 EU-A1011 | H | G | Q | G | T | F | T | S | D | Y | S | K | Y | L | D | E | Lys(M8) | A | A | K | E | F | I | A | W | L | L | N | T# |
| 958 EU-A1012 | H | G | Q | G | T | F | T | S | D | Y | S | K | Y | L | D | E | Lys(M12) | A | A | K | E | F | I | A | W | L | L | N | T# |
| 959 EU-A1013 | H | G | Q | G | T | F | T | S | D | Y | S | K | Y | L | D | E | Lys(M14) | A | A | K | E | F | I | A | W | L | L | N | T# |
| 960 EU-A1014 | H | G | Q | G | T | F | T | S | D | Y | S | K | Y | L | D | E | Lys(M16) | A | A | K | E | F | I | A | W | L | L | N | T# |
| 960 EU-A1015 | H | G | Q | G | T | F | T | S | D | Y | S | K | Y | L | D | E | Lys(M18) | A | A | K | E | F | I | A | W | L | L | N | T# |

Figure 9 (Continued)
Table 4 (Continued)

| SEQ ID. NO. | 1 | | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|---|
| EU-A101 5 | 961 | H | G | Q | G | T | F | T | S | D | Y | S | K | Y | L | D | E | Lys(M20) | A | A | K | E | F | I | A | W | L | L | Q | N | T# |
| EU-A101 6 | 962 | H | G | Q | G | T | F | T | S | D | Y | S | K | Y | L | D | E | Lys(M8) | A | A | R | E | F | I | A | W | L | L | Q | Q | T# |
| EU-A101 7 | 963 | H | G | Q | G | T | F | T | S | D | Y | S | K | Y | L | D | E | Lys(M12) | A | A | R | E | F | I | A | W | L | L | Q | Q | T# |
| EU-A101 8 | 964 | H | G | Q | G | T | F | T | S | D | Y | S | K | Y | L | D | E | Lys(M14) | A | A | R | E | F | I | A | W | L | L | Q | Q | T# |
| EU-A101 9 | 965 | H | G | Q | G | T | F | T | S | D | Y | S | K | Y | L | D | E | Lys(M16) | A | A | R | E | F | I | A | W | L | L | Q | Q | T# |
| EU-A102 0 | 966 | H | G | Q | G | T | F | T | S | D | Y | S | K | Y | L | D | E | Lys(M18) | A | A | R | E | F | I | A | W | L | L | Q | Q | T# |
| EU-A102 1 | 967 | H | G | Q | G | T | F | T | S | D | Y | S | K | Y | L | D | E | Lys(M20) | A | A | R | E | F | I | A | W | L | L | Q | Q | T# |
| EU-A102 2 | 968 | H | Aib | Q | G | T | F | T | S | D | Y | S | K | Y | L | D | E* | Q | A | A | K* | E | F | I | Lys(Me8) | W | L | L | Q | Q | T# |
| EU-A102 3 | 969 | H | Aib | Q | G | T | F | T | S | D | Y | S | K | Y | L | D | E* | Q | A | A | K* | E | F | I | Lys(Me1 2) | W | L | L | Q | Q | T# |
| EU-A102 4 | 970 | H | Aib | Q | G | T | F | T | S | D | Y | S | K | Y | L | D | E* | Q | A | A | K* | E | F | I | Lys(Me1 4) | W | L | L | Q | Q | T# |
| EU-A102 5 | 971 | H | Aib | Q | G | T | F | T | S | D | Y | S | K | Y | L | D | E* | Q | A | A | K* | E | F | I | Lys(Me1 6) | W | L | L | Q | Q | T# |

Figure 9 (Continued)
Table 4 (Continued)

| SEQ ID NO | | 1 | | | | 5 | | | | | 10 | | | | | 15 | | | | | 20 | | | | | 25 | | | | T# |
|---|---|---|---|---|---|---|---|---|---|---|---|---|---|---|---|---|---|---|---|---|---|---|---|---|---|---|---|---|---|---|
| 972 | EU-A1026 | H | Alb | Q | G | T | F | T | S | D | Y | S | K | Y | L | D | E* | Q | A | A | K* | E | F | I | Lys(Me18) | W | L | L | Q | T# |
| 973 | EU-A1027 | H | Alb | Q | G | T | F | T | S | D | Y | S | K | Y | L | D | E* | Q | A | A | K* | E | F | I | Lys(Me20) | W | L | L | Q | T# |
| 974 | EU-A1028 | H | G | Q | G | T | F | T | S | D | Y | S | K | Y | L | D | E | Q | A | A | R | E | F | I | Lys(Me8) | W | L | L | Q | T# |
| 975 | EU-A1029 | H | G | Q | G | T | F | T | S | D | Y | S | K | Y | L | D | E | Q | A | A | R | E | F | I | Lys(Me12) | W | L | L | Q | T# |
| 976 | EU-A1030 | H | G | Q | G | T | F | T | S | D | Y | S | K | Y | L | D | E | Q | A | A | R | E | F | I | Lys(Me14) | W | L | L | Q | T# |
| 977 | EU-A1031 | H | G | Q | G | T | F | T | S | D | Y | S | K | Y | L | D | E | Q | A | A | R | E | F | I | Lys(Me16) | W | L | L | Q | T# |
| 978 | EU-A1032 | H | G | Q | G | T | F | T | S | D | Y | S | K | Y | L | D | E | Q | A | A | R | E | F | I | Lys(Me18) | W | L | L | Q | T# |
| 979 | EU-A1033 | H | G | Q | G | T | F | T | S | D | Y | S | K | Y | L | D | E | Q | A | A | R | E | F | I | Lys(Me20) | W | L | L | Q | T# |
| 980 | EU-A1034 | H | G | Q | G | T | F | T | S | D | Y | S | K | Y | L | D | E | Lys(Me8) | A | A | K | E | F | I | A | W | L | L | N | T# |
| 981 | EU-A1035 | H | G | Q | G | T | F | T | S | D | Y | S | K | Y | L | D | E | Lys(Me12) | A | A | K | E | F | I | A | W | L | L | N | T# |
| 982 | EU-A1036 | H | G | Q | G | T | F | T | S | D | Y | S | K | Y | L | D | E | Lys(Me14) | A | A | K | E | F | I | A | W | L | L | N | T# |
| 983 | EU-A1037 | H | G | Q | G | T | F | T | S | D | Y | S | K | Y | L | D | E | Lys(Me16) | A | A | K | E | F | I | A | W | L | L | N | T# |

Figure 9 (Continued)
Table 4 (Continued)

| | SEQ ID. NO. | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|---|
| EU-A1038 | 984 | H | G | Q | G | T | F | T | S | D | Y | S | K | Y | L | D | E | Lys(Me18) | A | A | K | E | F | I | A | W | L | L | N | T# |
| EU-A1039 | 985 | H | G | Q | G | T | F | T | S | D | Y | S | K | Y | L | D | E | Lys(Me20) | A | A | K | E | F | I | A | W | L | L | N | T# |
| EU-A1040 | 986 | H | G | Q | G | T | F | T | S | D | Y | S | K | Y | L | D | E | Lys(Me8) | A | A | R | E | F | I | A | W | L | L | Q | T# |
| EU-A1041 | 987 | H | G | Q | G | T | F | T | S | D | Y | S | K | Y | L | D | E | Lys(Me12) | A | A | R | E | F | I | A | W | L | L | Q | T# |
| EU-A1042 | 988 | H | G | Q | G | T | F | T | S | D | Y | S | K | Y | L | D | E | Lys(Me14) | A | A | R | E | F | I | A | W | L | L | Q | T# |
| EU-A1043 | 989 | H | G | Q | G | T | F | T | S | D | Y | S | K | Y | L | D | E | Lys(Me16) | A | A | R | E | F | I | A | W | L | L | Q | T# |
| EU-A1044 | 990 | H | G | Q | G | T | F | T | S | D | Y | S | K | Y | L | D | E | Lys(Me18) | A | A | R | E | F | I | A | W | L | L | Q | T# |
| EU-A1045 | 991 | H | G | Q | G | T | F | T | S | D | Y | S | K | Y | L | D | E | Lys(Me20) | A | A | R | E | F | I | A | W | L | L | Q | T# |
| EU-A1046 | 992 | H | aMePro | Q | G | T | aMeF | T | S | D | EtBip | Lys(C8) | # | | | | | | | | | | | | | | | | |
| EU-A1047 | 993 | H | aMePro | Q | G | T | aMeF | T | S | D | EtBip | Lys(C12) | # | | | | | | | | | | | | | | | | |
| EU-A1048 | 994 | H | aMePro | Q | G | T | aMeF | T | S | D | EtBip | Lys(C14) | # | | | | | | | | | | | | | | | | |

Figure 9 (Continued)
Table 4 (Continued)

| | 1 | | | | 5 | | | | | 10 | | | 15 | | 20 | | 25 | | | |
|---|---|---|---|---|---|---|---|---|---|---|---|---|---|---|---|---|---|---|---|---|
| SEQ ID. NO. | | | | | | | | | | | | | | | | | | | | |
| EU-A104 9 | 995 | H | aMePro | Q | G | T | aMeF | T | S | D | EtBip | Lys(C16) | # | | | | | | | |
| EU-A105 0 | 996 | H | aMePro | Q | G | T | aMeF | T | S | D | EtBip | Lys(C18) | # | | | | | | | |
| EU-A105 1 | 997 | H | aMePro | Q | G | T | aMeF | T | S | D | EtBip | Lys(C20) | # | | | | | | | |
| EU-A105 2 | 998 | H | aMePro | Q | G | T | aMeF | T | S | D | EtBip | Lys(C8) | # | | | | | | | |
| EU-A105 3 | 999 | H | aMePro | Q | G | T | aMeF F | T | S | D | EtBip | Lys(C12) | # | | | | | | | |
| EU-A105 4 | 1000 | H | aMePro | Q | G | T | aMeF F | T | S | D | EtBip | Lys(C14) | # | | | | | | | |
| EU-A105 5 | 1001 | H | aMePro | Q | G | T | aMeF F | T | S | D | EtBip | Lys(C16) | # | | | | | | | |
| EU-A105 6 | 1002 | H | aMePro | Q | G | T | aMeF F | T | S | D | EtBip | Lys(C18) | # | | | | | | | |
| EU-A105 7 | 1003 | H | aMePro | Q | G | T | aMeF F | T | S | D | EtBip | Lys(C20) | # | | | | | | | |
| EU-A105 8 | 1004 | H | Aib | Q | G | T | aMeF | T | S | D | EtBip | Lys(C8) | # | | | | | | | |
| EU-A105 9 | 1005 | H | Aib | Q | G | T | aMeF | T | S | D | EtBip | Lys(C12) | # | | | | | | | |
| EU-A106 | 1006 | H | Aib | Q | G | T | aMeF | T | S | D | EtBip | Lys(C14) | # | | | | | | | |

Figure 9 (Continued)
Table 4 (Continued)

| | SEQ ID. NO. | 1 | | | | 5 | | | | | | 10 | | |  | 15 | | 20 | | 25 | | |
|---|---|---|---|---|---|---|---|---|---|---|---|---|---|---|---|---|---|---|---|---|---|---|
| EU-A1061 | 1007 | H | Aib | Q | G | T | αMeF | T | S | D | EtBip | Lys(C16) | # | | | | | | | | | |
| EU-A1062 | 1008 | H | Aib | Q | G | T | αMeF | T | S | D | EtBip | Lys(C18) | # | | | | | | | | | |
| EU-A1063 | 1009 | H | Aib | Q | G | T | αMeF | T | S | D | EtBip | Lys(C20) | # | | | | | | | | | |
| EU-A1064 | 1010 | H | Aib | Q | G | T | αMeF F | T | S | D | EtBip | Lys(C8) | # | | | | | | | | | |
| EU-A1065 | 1011 | H | Aib | Q | G | T | αMeF F | T | S | D | EtBip | Lys(C12) | # | | | | | | | | | |
| EU-A1066 | 1012 | H | Aib | Q | G | T | αMeF F | T | S | D | EtBip | Lys(C14) | # | | | | | | | | | |
| EU-A1067 | 1013 | H | Aib | Q | G | T | αMeF F | T | S | D | EtBip | Lys(C16) | # | | | | | | | | | |
| EU-A1068 | 1014 | H | Aib | Q | G | T | αMeF F | T | S | D | EtBip | Lys(C18) | # | | | | | | | | | |
| EU-A1069 | 1015 | H | Aib | Q | G | T | αMeF F | T | S | D | EtBip | Lys(C20) | # | | | | | | | | | |
| EU-A1070 | 1016 | H | αMePro | Q | G | T | αMeF | T | S | D | EtBip | MeLys(C8) | # | | | | | | | | | |
| EU-A1071 | 1017 | H | αMePro | Q | G | T | αMeF | T | S | D | EtBip | MeLys(C12) | # | | | | | | | | | |

Figure 9 (Continued)
Table 4 (Continued)

| | 1 | | | | 5 | | | | | | 10 | | | 15 | | 20 | | 25 | | | | |
|---|---|---|---|---|---|---|---|---|---|---|---|---|---|---|---|---|---|---|---|---|---|---|
| SEQ ID. NO. | | | | | | | | | | | | | | | | | | | | | | |
| EU-A107 2 | 1018 | H | aMePro | Q | G | T | aMeF | T | S | D | EtBip | MeLys(C 14) | # | | | | | | | | | |
| EU-A107 3 | 1019 | H | aMePro | Q | G | T | aMeF | T | S | D | EtBip | MeLys(C 16) | # | | | | | | | | | |
| EU-A107 4 | 1020 | H | aMePro | Q | G | T | aMeF | T | S | D | EtBip | MeLys(C 18) | # | | | | | | | | | |
| EU-A107 5 | 1021 | H | aMePro | Q | G | T | aMeF | T | S | D | EtBip | MeLys(C 20) | # | | | | | | | | | |
| EU-A107 6 | 1022 | H | aMePro | Q | G | T | aMeF F | T | S | D | EtBip | MeLys(C 8) | # | | | | | | | | | |
| EU-A107 7 | 1023 | H | aMePro | Q | G | T | aMeF F | T | S | D | EtBip | MeLys(C 12) | # | | | | | | | | | |
| EU-A107 8 | 1024 | H | aMePro | Q | G | T | aMeF F | T | S | D | EtBip | MeLys(C 14) | # | | | | | | | | | |
| EU-A107 9 | 1025 | H | aMePro | Q | G | T | aMeF F | T | S | D | EtBip | MeLys(C 16) | # | | | | | | | | | |
| EU-A108 0 | 1026 | H | aMePro | Q | G | T | aMeF F | T | S | D | EtBip | MeLys(C 18) | # | | | | | | | | | |
| EU-A108 1 | 1027 | H | aMePro | Q | G | T | aMeF | T | S | D | EtBip | MeLys(C 20) | # | | | | | | | | | |
| EU-A108 2 | 1028 | H | Aib | Q | G | T | aMeF | T | S | D | EtBip | MeLys(C 8) | # | | | | | | | | | |
| EU-A108 | 1029 | H | Aib | Q | G | T | aMeF | T | S | D | EtBip | MeLys(C 12) | # | | | | | | | | | |

Figure 9 (Continued)
Table 4 (Continued)

| SEQ ID. NO. | 1 | 2 | 3 | 4 | 5 | 6 | 7 | 8 | 9 | 10 | 11 | 12 | | 15 | | | | | 20 | | | | | 25 | | |
|---|---|---|---|---|---|---|---|---|---|---|---|---|---|---|---|---|---|---|---|---|---|---|---|---|---|---|
| EU-A1084 | 1030 | H | Aib | Q | G | T | aMeF | T | S | D | EtBip | MeLys(C14) | # | | | | | | | | | | | | | |
| EU-A1085 | 1031 | H | Aib | Q | G | T | aMeF | T | S | D | EtBip | MeLys(C16) | # | | | | | | | | | | | | | |
| EU-A1086 | 1032 | H | Aib | Q | G | T | aMeF | T | S | D | EtBip | MeLys(C18) | # | | | | | | | | | | | | | |
| EU-A1087 | 1033 | H | Aib | Q | G | T | aMeF | T | S | D | EtBip | MeLys(C20) | # | | | | | | | | | | | | | |
| EU-A1088 | 1034 | H | Aib | Q | G | T | aMeF | T | S | D | EtBip | MeLys(C8) | # | | | | | | | | | | | | | |
| EU-A1089 | 1035 | H | Aib | Q | G | T | aMeF | T | S | D | EtBip | MeLys(C12) | # | | | | | | | | | | | | | |
| EU-A1090 | 1036 | H | Aib | Q | G | T | aMeF | T | S | D | EtBip | MeLys(C14) | # | | | | | | | | | | | | | |
| EU-A1091 | 1037 | H | Aib | Q | G | T | aMeF | T | S | D | EtBip | MeLys(C16) | # | | | | | | | | | | | | | |
| EU-A1092 | 1038 | H | Aib | Q | G | T | aMeF | T | S | D | EtBip | MeLys(C18) | # | | | | | | | | | | | | | |
| EU-A1093 | 1039 | H | Aib | Q | G | T | aMeF | T | S | D | EtBip | MeLys(C20) | # | | | | | | | | | | | | | |
| EU-A1094 | 1040 | H | aMePro | Q | G | T | aMeF | T | S | D | EtBip | Me8 | # | | | | | | | | | | | | | |

Figure 9 (Continued)
Table 4 (Continued)

| | SEQ ID. NO. | 1 | | | | 5 | | | | | | 10 | | | | | 15 | | | | | 20 | | | | | 25 |
|---|---|---|---|---|---|---|---|---|---|---|---|---|---|---|---|---|---|---|---|---|---|---|---|---|---|---|---|
| EU-A1095 | 1041 | H | aMePro | Q | G | T | aMeF | T | S | D | EtBip | Me12 | # | | | | | | | | | | | | | |
| EU-A1096 | 1042 | H | aMePro | Q | G | T | aMeF | T | S | D | EtBip | Me14 | # | | | | | | | | | | | | | |
| EU-A1097 | 1043 | H | aMePro | Q | G | T | aMeF | T | S | D | EtBip | Me16 | # | | | | | | | | | | | | | |
| EU-A1098 | 1044 | H | aMePro | Q | G | T | aMeF | T | S | D | EtBip | Me18 | # | | | | | | | | | | | | | |
| EU-A1099 | 1045 | H | aMePro | Q | G | T | aMeF | T | S | D | EtBip | Me20 | # | | | | | | | | | | | | | |
| EU-A1100 | 1046 | H | aMePro | Q | G | T | aMeFF | T | S | D | EtBip | Me8 | # | | | | | | | | | | | | | |
| EU-A1101 | 1047 | H | aMePro | Q | G | T | aMeFF | T | S | D | EtBip | Me12 | # | | | | | | | | | | | | | |
| EU-A1102 | 1048 | H | aMePro | Q | G | T | aMeFF | T | S | D | EtBip | Me14 | # | | | | | | | | | | | | | |
| EU-A1103 | 1049 | H | aMePro | Q | G | T | aMeFF | T | S | D | EtBip | Me16 | # | | | | | | | | | | | | | |
| EU-A1104 | 1050 | H | aMePro | Q | G | T | aMeFF | T | S | D | EtBip | Me18 | # | | | | | | | | | | | | | |
| EU-A1105 | 1051 | H | aMePro | Q | G | T | aMeFF | T | S | D | EtBip | Me20 | # | | | | | | | | | | | | | |
| EU-A110 | 1052 | H | Aib | Q | G | T | aMeF | T | S | D | EtBip | Me8 | # | | | | | | | | | | | | | |

Figure 9 (Continued)
Table 4 (Continued)

| SEQ ID. NO. | 1 | | | | 5 | | | | | | 10 | | | | | 15 | | | | | 20 | | | | | 25 | | | | | |
|---|---|---|---|---|---|---|---|---|---|---|---|---|---|---|---|---|---|---|---|---|---|---|---|---|---|---|---|---|---|---|
| 6 | | | | | | | | | | | | | | | | | | | | | | | | | | | | | | |
| EU-A1107 1053 | H | Aib | Q | G | T | αMeF | T | S | D | EtBip | Me12 | # | | | | | | | | | | | | | | | | | | |
| EU-A1108 1054 | H | Aib | Q | G | T | αMeF | T | S | D | EtBip | Me14 | # | | | | | | | | | | | | | | | | | | |
| EU-A1109 1055 | H | Aib | Q | G | T | αMeF | T | S | D | EtBip | Me16 | # | | | | | | | | | | | | | | | | | | |
| EU-A1110 1056 | H | Aib | Q | G | T | αMeF | T | S | D | EtBip | Me18 | # | | | | | | | | | | | | | | | | | | |
| EU-A1111 1057 | H | Aib | Q | G | T | αMeF F | T | S | D | EtBip | Me20 | # | | | | | | | | | | | | | | | | | | |
| EU-A1112 1058 | H | Aib | Q | G | T | αMeF F | T | S | D | EtBip | Me8 | # | | | | | | | | | | | | | | | | | | |
| EU-A1113 1059 | H | Aib | Q | G | T | αMeF F | T | S | D | EtBip | Me12 | # | | | | | | | | | | | | | | | | | | |
| EU-A1114 1060 | H | Aib | Q | G | T | αMeF F | T | S | D | EtBip | Me14 | # | | | | | | | | | | | | | | | | | | |
| EU-A1115 1061 | H | Aib | Q | G | T | αMeF F | T | S | D | EtBip | Me16 | # | | | | | | | | | | | | | | | | | | |
| EU-A1116 1062 | H | Aib | Q | G | T | αMeF F | T | S | D | EtBip | Me18 | # | | | | | | | | | | | | | | | | | | |
| EU-A1117 1063 | H | Aib | Q | G | T | αMeF F | T | S | D | EtBip | Me20 | # | | | | | | | | | | | | | | | | | | |

Figure 9 (Continued)
Table 4 (Continued)

| | SEQ ID. NO. | 1 | | | 5 | | | | | | 10 | | 15 | 20 | 25 |
|---|---|---|---|---|---|---|---|---|---|---|---|---|---|---|---|
| EU-A118 | 1064 | H | aMePro | Q | G | T | aMeF | T | S | D | Bip | MeLys(C 8) | # | | |
| EU-A119 | 1065 | H | aMePro | Q | G | T | aMeF | T | S | D | Bip | MeLys(C 12) | # | | |
| EU-A120 | 1066 | H | aMePro | Q | G | T | aMeF | T | S | D | Bip | MeLys(C 14) | # | | |
| EU-A121 | 1067 | H | aMePro | Q | G | T | aMeF | T | S | D | Bip | MeLys(C 16) | # | | |
| EU-A122 | 1068 | H | aMePro | Q | G | T | aMeF | T | S | D | Bip | MeLys(C 18) | # | | |
| EU-A123 | 1069 | H | aMePro | Q | G | T | aMeF | T | S | D | Bip | MeLys(C 20) | # | | |
| EU-A124 | 1070 | H | aMePro | Q | G | T | aMeF F | T | S | D | Bip | MeLys(C 8) | # | | |
| EU-A125 | 1071 | H | aMePro | Q | G | T | aMeF F | T | S | D | Bip | MeLys(C 12) | # | | |
| EU-A126 | 1072 | H | aMePro | Q | G | T | aMeF F | T | S | D | Bip | MeLys(C 14) | # | | |
| EU-A127 | 1073 | H | aMePro | Q | G | T | aMeF F | T | S | D | Bip | MeLys(C 16) | # | | |
| EU-A128 | 1074 | H | aMePro | Q | G | T | aMeF F | T | S | D | Bip | MeLys(C 18) | # | | |
| EU-A129 | 1075 | H | aMePro | Q | G | T | aMeF F | T | S | D | Bip | MeLys(C 20) | # | | |

Figure 9 (Continued)
Table 4 (Continued)

| | SEQ ID. NO. | 1 | | | | 5 | | | | | 10 | | 15 | 20 | 25 |
|---|---|---|---|---|---|---|---|---|---|---|---|---|---|---|---|
| EU-A1130 | 1076 | H | Aib | Q | G | T | αMeF | T | S | D | Bip | MeLys(C8) # | | | |
| EU-A1131 | 1077 | H | Aib | Q | G | T | αMeF | T | S | D | Bip | MeLys(C12) # | | | |
| EU-A1132 | 1078 | H | Aib | Q | G | T | αMeF | T | S | D | Bip | MeLys(C14) # | | | |
| EU-A1133 | 1079 | H | Aib | Q | G | T | αMeF | T | S | D | Bip | MeLys(C16) # | | | |
| EU-A1134 | 1080 | H | Aib | Q | G | T | αMeF | T | S | D | Bip | MeLys(C18) # | | | |
| EU-A1135 | 1081 | H | Aib | Q | G | T | αMeF | T | S | D | Bip | MeLys(C20) # | | | |
| EU-A1136 | 1082 | H | Aib | Q | G | T | αMeF F | T | S | D | Bip | MeLys(C8) # | | | |
| EU-A1137 | 1083 | H | Aib | Q | G | T | αMeF F | T | S | D | Bip | MeLys(C12) # | | | |
| EU-A1138 | 1084 | H | Aib | Q | G | T | αMeF F | T | S | D | Bip | MeLys(C14) # | | | |
| EU-A1139 | 1085 | H | Aib | Q | G | T | αMeF F | T | S | D | Bip | MeLys(C16) # | | | |
| EU-A1140 | 1086 | H | Aib | Q | G | T | αMeF F | T | S | D | Bip | MeLys(C18) # | | | |

Figure 9 (Continued)
Table 4 (Continued)

| | SEQ ID. NO. | 1 | | | 5 | | | | 10 | | | | 15 | | 20 | | 25 | | | | | | | | |
|---|---|---|---|---|---|---|---|---|---|---|---|---|---|---|---|---|---|---|---|---|---|---|---|---|---|
| EU-A114-1 | 1087 | H | Aib | Q | G | T | aMeF | T | S | D | Bip | MeLys(C20) | # | | | | | | | | | | | | |
| EU-A114-2 | 1088 | H | aMePro | Q | G | T | aMeF | T | S | D | Bip | Me8 | # | | | | | | | | | | | | |
| EU-A114-3 | 1089 | H | aMePro | Q | G | T | aMeF | T | S | D | Bip | Me12 | # | | | | | | | | | | | | |
| EU-A114-4 | 1090 | H | aMePro | Q | G | T | aMeF | T | S | D | Bip | Me14 | # | | | | | | | | | | | | |
| EU-A114-5 | 1091 | H | aMePro | Q | G | T | aMeF | T | S | D | Bip | Me16 | # | | | | | | | | | | | | |
| EU-A114-6 | 1092 | H | aMePro | Q | G | T | aMeF | T | S | D | Bip | Me18 | # | | | | | | | | | | | | |
| EU-A114-7 | 1093 | H | aMePro | Q | G | T | aMeF | T | S | D | Bip | Me20 | # | | | | | | | | | | | | |
| EU-A114-8 | 1094 | H | aMePro | Q | G | T | aMeF | T | S | D | Bip | Me8 | # | | | | | | | | | | | | |
| EU-A114-9 | 1095 | H | aMePro | Q | G | T | aMeF | T | S | D | Bip | Me12 | # | | | | | | | | | | | | |
| EU-A115-0 | 1096 | H | aMePro | Q | G | T | aMeF | T | S | D | Bip | Me14 | # | | | | | | | | | | | | |
| EU-A115-1 | 1097 | H | aMePro | Q | G | T | aMeF | T | S | D | Bip | Me16 | # | | | | | | | | | | | | |
| EU-A115-2 | 1098 | H | aMePro | Q | G | T | aMeF | T | S | D | Bip | Me18 | # | | | | | | | | | | | | |

Figure 9 (Continued)
Table 4 (Continued)

| SEQ ID. NO. | 1 | | | | 5 | | | | | 10 | | | | 15 | 20 | 25 | | | | | | | | | | | |
|---|---|---|---|---|---|---|---|---|---|---|---|---|---|---|---|---|---|---|---|---|---|---|---|---|---|---|---|
| | | | | | | | | | | | | | | | | | | | | | | | | | | | |
| 1099 | H | aMePro | Q | G | T | aMeF | T | S | D | Bip | Me20 | # | | | | | | | | | | | | | | | |
| 1100 | H | Aib | Q | G | T | aMeF | T | S | D | Bip | Me8 | # | | | | | | | | | | | | | | | |
| 1101 | H | Aib | Q | G | T | aMeF | T | S | D | Bip | Me12 | # | | | | | | | | | | | | | | | |
| 1102 | H | Aib | Q | G | T | aMeF | T | S | D | Bip | Me14 | # | | | | | | | | | | | | | | | |
| 1103 | H | Aib | Q | G | T | aMeF | T | S | D | Bip | Me16 | # | | | | | | | | | | | | | | | |
| 1104 | H | Aib | Q | G | T | aMeF | T | S | D | Bip | Me18 | # | | | | | | | | | | | | | | | |
| 1105 | H | Aib | Q | G | T | aMeF | T | S | D | Bip | Me20 | # | | | | | | | | | | | | | | | |
| 1106 | H | Aib | Q | G | T | aMeF | T | S | D | Bip | Me8 | # | | | | | | | | | | | | | | | |
| 1107 | H | Aib | Q | G | T | aMeF | T | S | D | Bip | Me12 | # | | | | | | | | | | | | | | | |
| 1108 | H | Aib | Q | G | T | aMeF | T | S | D | Bip | Me14 | # | | | | | | | | | | | | | | | |
| 1109 | H | Aib | Q | G | T | aMeF | T | S | D | Bip | Me16 | # | | | | | | | | | | | | | | | |

(Row labels: EU-A1153, EU-A1154, EU-A1155, EU-A1156, EU-A1157, EU-A1158, EU-A1159, EU-A1160, EU-A1161, EU-A1162, EU-A1163)

Figure 9 (Continued)
Table 4 (Continued)

| SEQ ID NO. | | 1 | | | | 5 | | | | | | 10 | | | | | | 15 | | | | | 20 | | | | | | 25 | | | | |
|---|---|---|---|---|---|---|---|---|---|---|---|---|---|---|---|---|---|---|---|---|---|---|---|---|---|---|---|---|---|---|---|---|
| EU-A1164 | 1110 | H | Aib | Q | G | T | αMeF | T | S | D | Bip | Me18 | # | | | | | | | | | | | | | | | | | | | |
| EU-A1165 | 1111 | H | Aib | Q | G | T | αMeF | T | S | D | Bip | Me20 | # | | | | | | | | | | | | | | | | | | | |
| EU-A1166 | 1112 | H | Aib | Q | G | T | F | T | S | D | Y | S | K | Y | L | D | E* | Q | A | A | K* | E | F | I | Lys(C9) | W | L | L | Q | T# |
| EU-A1167 | 1113 | H | Aib | Q | G | T | F | T | S | D | Y | S | K | Y | L | D | E* | Q | A | A | K* | E | F | I | Lys(C10) | W | L | L | Q | T# |
| EU-A1168 | 1114 | H | Aib | Q | G | T | F | T | S | D | Y | S | K | Y | L | D | E* | Q | A | A | K* | E | F | I | Lys(C11) | W | L | L | Q | T# |
| EU-A1169 | 1115 | H | Aib | Q | G | T | F | T | S | D | Y | S | K | Y | L | D | E* | Q | A | A | K* | E | F | I | Lys(Me*8) | W | L | L | Q | T# |
| EU-A1170 | 1116 | H | Aib | Q | G | T | F | T | S | D | Y | S | K | Y | L | D | E* | Q | A | A | K* | E | F | I | Lys(Me*10) | W | L | L | Q | T# |
| EU-A1171 | 1117 | H | Aib | Q | G | T | F | T | S | D | Y | S | K | Y | L | D | E* | Q | A | A | K* | E | F | I | Lys(Me*12) | W | L | L | Q | T# |
| EU-A1172 | 1118 | H | Aib | Q | G | T | F | T | S | D | Y | S | K | Y | L | D | E* | Q | A | A | K* | E | F | I | Lys(Me*14) | W | L | L | Q | T# |
| EU-A1173 | 1119 | H | Aib | Q | G | T | F | T | S | D | Y | S | K | Y | L | D | E* | Q | A | A | K* | E | F | I | Lys(Me*16) | W | L | L | Q | T# |
| EU-A1174 | 1120 | H | Aib | Q | G | T | F | T | S | D | Y | S | K | Y | L | D | E* | Q | A | A | K* | E | F | I | Lys(Me*18) | W | L | L | Q | T# |

Figure 9 (Continued)

Table 4 (Continued)

C with a numeral means 1-alkyl beta-D-glucouronyl acyl group, while the numeral denotes the chain length.

MeLys = C-alpha-methyl-lysine, EtBip = 2'-ethyl-biphenylalanine; aMeF = C-α-methyl-Phe; aMeFF = C-α-methyl-2-fluoro-Phe M is maltoside and Me is melibioside-based surfactant, while the numeral is the carbon chain length of the 1-alkyl substitution. Starred means alpha linked glycoside. For example Me* means alpha- melibioside.

Lys(C12) means N-epsilon-(1'-dodecyl beta-D-glucurony)-L-lysine and other C numbers mean the corresponding 1'-alkyl glucoronide. The pair of amino acids E*, K*, or K*, E* separated by 4 residues denotes a side chain lactam linkage formed between the side chain functional groups on these amino acids.

# means amide C-terminus.

| EU-A992 | 938 | H | Aib | Q | G | T | F | T | S | D | Y | S | K | Y | L | D | E* | Q | A | A | K* | E | F | I | Lys(C8) | W | L | L | Q | T# |

PEPTIDE PHARMACEUTICALS

INCORPORATION BY REFERENCE

This application claims the benefit of U.S. Provisional Patent Application Ser. No. 61/728,667, filed Nov. 20, 2012, which is incorporated herein by reference in its entirety.

SEQUENCE LISTING

The instant application contains a Sequence Listing which has been submitted in ASCII format via EFS-Web and hereby incorporated by reference in its entirety. Said ASCII copy, created on Jul. 30, 2015, is named 38617-701-832_SL and is 695,217 bytes in size.

FIELD OF THE INVENTION

Covalently modified peptide and protein analogs allow for improved pharmaceutical properties of peptide and/or protein-based therapeutics.

SUMMARY OF THE INVENTION

Peptide and/or protein pharmaceuticals suffer from several limitations in their use in medicine (Nestor, J. J., Jr. (2007) Comprehensive Medicinal Chemistry II 2: 573-601)—short duration of action, poor bioavailability, and lack of receptor subtype selectivity. In addition, peptides and/or proteins are unstable in formulations, being subject to aggregation. In some instances, aggregation of peptides and/or proteins leads to the development of an immunological response to both native and foreign peptides or proteins.

Described herein is a method and reagents for covalently modifying peptides and/or proteins to generate products with improved pharmaceutical properties. In some instances, covalently modified peptides and/or proteins allow for improved stability, bioavailability, selectivity, and duration of effect in peptide and/or protein-based therapeutics.

Described herein are certain covalently modified peptides and/or proteins with improved pharmaceutical properties. In some instances, these covalently modified peptides and/or proteins allow for improved stability, bioavailability, selectivity, and duration of effect in peptide and/or protein-based therapeutics.

In some embodiments, the covalently modified peptides and/or proteins described herein are attached to glycoside surfactants. In one aspect, the covalently modified peptides and/or proteins are attached to alkyl glycosides. In one aspect, the covalently modified peptides and/or proteins are attached to an alkyl glycoside surfactant wherein the peptide and/or protein is attached to the glycoside in the surfactant and the glycoside is then attached to a hydrophobic and/or alkyl group. Provided herein, in some embodiments, are reagents and intermediates for the covalent modification of peptides and/or proteins through the incorporation of surfactants such as alkyl glycosides.

Provided herein are peptide products comprising a surfactant X, covalently attached to a peptide, the peptide comprising a linker amino acid U and at least one other amino acid:

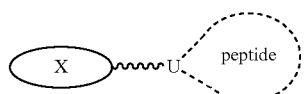

Formula I wherein X is

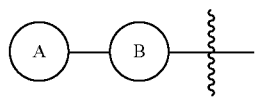

wherein
A is a hydrophobic group; and
B is a hydrophilic group covalently attached to the peptide via a linker amino acid U.

In some embodiments, the peptide product is synthesized by reaction of a functionalized surfactant with the peptide as described herein. In some embodiments, the peptide product is synthesized by reaction of a functionalized surfactant with a reversibly-protected linker amino acid as described herein followed by reaction with one or more amino acids to form a surfactant-modified peptide product. In some embodiments, U is a terminal amino acid of the peptide. In some embodiments, U is a non-terminal amino acid of the peptide.

In some embodiments, A is a substituted or unsubstituted $C_1$-$C_{30}$ alkyl chain, a substituted or unsubstituted alkoxyaryl group, a substituted or unsubstituted aralkyl group or a steroid nucleus containing moiety. In some embodiments, A is a substituted or unsubstituted $C_8$-$C_{20}$ alkyl chain, a substituted or unsubstituted 1-alkoxyaryl group, a substituted or unsubstituted 1-aralkyl group, or a steroid nucleus containing moiety. In some embodiments, A is a substituted or unsubstituted $C_{10}$-$C_{20}$ alkyl chain, a substituted or unsubstituted 1-alkoxyaryl group, a substituted or unsubstituted 1-aralkyl group, or a steroid nucleus containing moiety.

In some embodiments, B is a polyol. In some embodiments, the polyol is a saccharide. In some embodiments, the saccharide is a monosaccharide, a disaccharide, or a polysaccharide. In some embodiments, the saccharide is selected from glucose, mannose, maltose, a glucuronic acid, galacturonic acid, diglucuronic acid and maltouronic acid.

In some embodiments, the surfactant is a 1-alkyl glycoside class surfactant.

In some embodiments, the hydrophilic group in the surfactant is attached to the peptide via an amide bond.

In some embodiments of the peptide product, the surfactant is comprised of 1-eicosyl beta-D-glucuronic acid, 1-octadecyl beta-D-glucuronic acid, 1-hexadecyl beta-D-glucuronic acid, 1-tetradecylbeta D-glucuronic acid, 1-dodecyl beta D-glucuronic acid, 1-decyl beta-D-glucuronic acid, 1-octyl beta-D-glucuronic acid, 1-eicosyl beta-D-diglucuronic acid, 1-octadecyl beta-D-diglucuronic acid, 1-hexadecyl beta-D-diglucuronic acid, 1-tetradecyl beta-D-diglucuronic acid, 1-dodecyl beta-D-diglucuronic acid, 1-decyl beta-D-diglucuronic acid, 1-octyl beta-D-diglucuronic acid, or functionalized 1-ecosyl beta-D-glucose, 1-octadecyl beta-D-glucose, 1-hexadecyl beta-D-glucose, 1-tetradecyl beta-D-glucose, 1-dodecyl beta-D-glucose, 1-decyl beta-D-glucose, 1-octyl beta-D-glucose, 1-eicosyl beta-D-maltoside, 1-octadecyl beta-D-maltoside, 1-hexadecyl beta-D-maltoside, 1-dodecyl beta-D-maltoside, 1-decyl beta-D-maltoside, 1-octyl beta-D-maltoside, and the like, and the peptide product is prepared by formation of a linkage between the aforementioned groups and a group on the peptide (e.g., a —COOH group in the aforementioned groups and an amino group of the peptide).

In some embodiments, a combination of a hydrophilic with a hydrophobic group generates a surfactant. In some embodiments, the surfactant is an ionic surfactant. In some embodiments, the surfactant is a non-ionic surfactant. In some embodiments, the hydrophobic group is a substituted or unsubstituted $C_1$-$C_{30}$ alkyl chain or an aralkyl chain. In some embodiments the hydrophobic group is a chain having mixed hydrophobic and hydrophilic properties, for example a polyethylene glycol (PEG) group.

In some embodiments, the linker amino acid is a natural D- or L-amino acid. In some embodiments, the linker amino acid is an unnatural amino acid. In some embodiments, the linker amino acid is selected from Lys, Cys, Orn, Asp, Glu or an unnatural amino acid, comprising a functional group used for covalent attachment to the surfactant X. In some embodiments, the linker amino acid is selected from Lys, Cys, Orn, or an unnatural amino acid, comprising a functional group used for covalent attachment to the surfactant X. In some embodiments, the functional group used for covalent attachment to a surfactant is —NH$_2$, —SH, —OH, —N$_3$, haloacetyl, a —(CH2)$_m$-maleimide or an acetylenic group, wherein m is 1-10.

In some embodiments, the peptide is an opioid peptide. In some embodiments, the peptide and/or protein product contains a covalently linked alkyl glycoside. In some of such embodiments, the peptide and/or protein product contains a covalently linked alkyl glycoside that is a 1-O-alkyl glucuronic acid of alpha or beta configuration. In some of such embodiments, the peptide and/or protein product comprises a covalently linked alkyl glycoside that is a 1-O-alkyl glucuronic acid and the alkyl chain is a $C_1$ to $C_{20}$ alkyl chain.

In some embodiments, the peptide product has a structure of Formula IA:

Formula IA wherein:
each of aa$_1$, aa$_2$, aa$_3$, aa$_4$, and aa$_5$ is independently absent, a D- or L-natural or unnatural amino acid, an N-alkylated amino acid, an N-acetylated amino acid, a C$\alpha$R$^3$ amino acid, a $\Psi$-amino acid, or a linker amino acid U covalently attached to the surfactant X;
Z is —OH, —NH$_2$ or —NHR$^3$;
each R$^3$ is independently substituted or unsubstituted $C_1$-$C_{12}$ branched or straight chain alkyl, a PEG chain of less than 10 Da, or substituted or unsubstituted aralkyl chain;
provided that one, or at least one of aa$_1$, aa$_2$, aa$_3$, aa$_4$, and aa$_5$ is the linker amino acid U covalently attached to the surfactant X;
and further provided that not all of aa$_1$, aa$_2$, aa$_3$, aa$_4$, and aa$_5$ are absent.

In one aspect, provided herein is a peptide product having a structure of Formula II:

Formula II wherein:
each of aa$_1$, aa$_2$, aa$_3$, aa$_4$, and aa$_5$ is independently absent, a D- or L-natural or unnatural amino acid, an N-alkylated amino acid, an N-acetylated amino acid, a C$\alpha$R$^3$ amino acid, a $\Psi$-amino acid, or a linker amino acid U covalently attached to a surfactant X;
Z is —OH, —NH$_2$ or —NHR$^3$;

each R$^3$ is independently substituted or unsubstituted $C_1$-$C_{12}$ branched or straight chain alkyl, a PEG chain of less than 10 Da, or substituted or unsubstituted aralkyl chain; and
X is

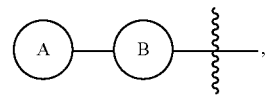

wherein
A is a hydrophobic group; and
B is a hydrophilic group covalently attached to the peptide via a linker amino acid U;
provided that one, or at least one of aa$_1$, aa$_2$, aa$_3$, aa$_4$, and aa$_5$ is the linker amino acid U covalently attached to the surfactant X;
and further provided that not all of aa$_1$, aa$_2$, aa$_3$, aa$_4$, and aa$_5$ are absent.

In one aspect, provided herein is a peptide product that has a structure of Formula III:

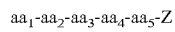

Formula III (SEQ. ID. NO. 1)

wherein:
aa$_1$ is Tyr, Dmt, N—R$^3$-Tyr, N—R$^3$-Dmt, N—(R$^3$)$_2$-Tyr, or N—(R$^3$)$_2$-Dmt;
aa$_2$ is Pro, D-Arg, D-U(X), D-Ala, Tic, or Tic($\Psi$[CH2-NH]);
aa$_3$ is Phe, Trp, Tmp, D- or L-Nal(1), D- or L-Nal(2), C$\alpha$MePhe, or $\Psi$-Phe;
aa$_4$ is Phe, Tmp, D- or L-Nal(1), D- or L-Nal(2), U(X), D- or L-C$\alpha$MeU(X);
aa$_5$ is absent or Pro, Aib, U(X), D- or L-C$\alpha$MeU(X); and
U is a dibasic natural or unnatural amino acid, a natural or unnatural amino acid comprising a thiol, an unnatural amino acid comprising a —N$_3$ group, an unnatural amino acid comprising an acetylenic group, or an unnatural amino acid comprising a —NH—C(=O)—CH$_2$—Br or a —(CH$_2$)$_m$-maleimide, wherein m is 1-10, used for covalent attachment to the surfactant X.

In some embodiments of peptide products of Formula I, Formula II or Formula III described above and herein, X has the structure:

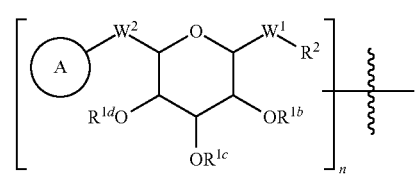

Formula V wherein:
A is a substituted or unsubstituted $C_1$-$C_{30}$ alkyl chain, a substituted or unsubstituted alkoxyaryl group, a substituted or unsubstituted aralkyl group, or a steroid nucleus containing moiety;
R$^{1b}$, R$^{1c}$, and R$^{1d}$ are each, independently at each occurrence, H, a protecting group, a saccharide, a substituted or unsubstituted $C_1$-$C_{30}$ alkyl group, a substituted or unsubstituted alkoxyaryl group, or a substituted or unsubstituted aralkyl group;

$W^1$ is independently, at each occurrence, —CH$_2$—, —CH$_2$—O—, —(C=O), —(C=O)—O—, —(C=O)—NH—, —(C=S)—, —(C=S)—NH—, or —CH$_2$—S—;

$W^2$ is —O—, or —S—;

$R^2$ is a bond, C$_2$-C$_4$-alkene, C$_2$-C$_4$-alkyne, or —(CH$_2$)$_m$-maleimide; and m is 1-10.

In some embodiments of peptide products of Formula I, Formula II or Formula III described above and herein, X has the structure:

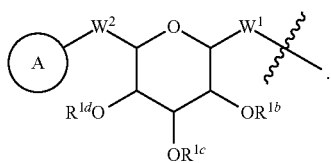

Accordingly, in the embodiment described above, $R^2$ is a bond.

In some embodiments of peptide products of Formula I, Formula II or Formula III described above and herein, X has the structure:

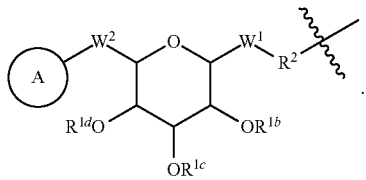

In some embodiments of peptide products of Formula I, Formula II or Formula III described above and herein, X has the structure:

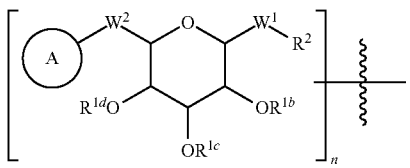

Formula V wherein:

A is a substituted or unsubstituted C$_1$-C$_{30}$ alkyl group, or a steroid nucleus containing moiety;

$R^{1b}$, $R^{1c}$, and $R^{1d}$ are each, independently at each occurrence, H, a protecting group, a saccharide or a substituted or unsubstituted C$_1$-C$_{30}$ alkyl group;

$W^1$ is —(C=O)—NH—;

$W^2$ is —O—;

$R^2$ is a bond.

In some embodiments of peptide products of Formula I, Formula II or Formula III described above and herein, X has the structure:

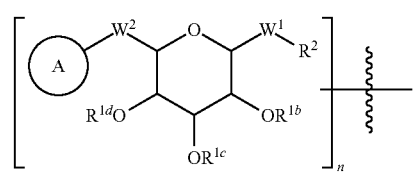

Formula V wherein:

A is a substituted or unsubstituted C$_1$-C$_{30}$ alkyl group;

$R^{1b}$, $R^{1c}$, and $R^{1d}$ are H;

$W^1$ is —(C=O)—NH—;

$W^2$ is —O—; and $R^2$ is a bond.

In some embodiments of peptide products of Formula I, Formula II or Formula III described above and herein, X is as described above and A is a substituted or unsubstituted C$_1$-C$_{20}$ alkyl group.

In some embodiments described above and herein, $R^{1a}$ is a saccharide. In some embodiments, the saccharide is a galactose. In certain embodiments, the saccharide is an alpha-linked galactose. In other embodiments, the saccharide is alpha-linked galactopyranose, beta-linked galactopyranose, alpha-linked galactofuranose, or beta-linked galactofuranose.

Also contemplated herein are alternate embodiments wherein X in Formula I has the structure:

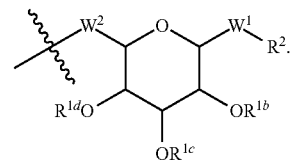

For instance, in an exemplary embodiment of the structure of X described above, $W^1$ is —S—, $R^2$ is a C$_1$-C$_{30}$ alkyl group, $W^2$ is S, $R^{1a}$ is a bond between $W^2$ and a suitable moiety of an amino acid residue U within the peptide (e.g., a thiol group in a cysteine residue of the peptide forms a thioether with X).

In another exemplary alternate embodiment of the structure of X described above, $W^1$ is —O—, $R^2$ is a C$_1$-C$_{30}$ alkyl group, $W^2$ is O, $R^{1a}$ is a bond between $W^2$ and a suitable moiety of an amino acid residue U within the peptide (e.g., a hydroxyl group in a serine or threonine residue of the peptide forms an ether with X).

In some embodiments, a peptide product of Formula III is a product (SEQ. ID. NO. 149)

wherein:

U is a dibasic natural or unnatural amino acid;

X is a surfactant of the 1-alkyl glycoside class wherein 1-alkyl is substituted or unsubstituted C$_1$-C$_{20}$ alkyl or a substituted or unsubstituted alkoxyaryl substituent;

Z is NH$_2$;

aa$_1$ is Tyr, Dmt, Nα-Me-Tyr, Nα-Me-Tyr, N,Nα-diMe-Tyr, or N,Nα-diMe-Dmt;

aa$_2$ is Pro, D-Arg, D-Cit, D-U(X), D-Ala, Tic, or Tic(Ψ[CH2-NH]);

aa$_3$ is Phe, Trp, Tmp, D- or L-Nal(1), D- or L-Nal(2), CαMePhe, or Ψ-Phe;

aa$_4$ is Phe, Tmp, D- or L-Nal(1), D- or L-Nal(2), U(X), D- or L-CαMeU(X);
aa$_5$ is absent or Pro, Aib, U(X), D- or L-CαMeU(X).

In some embodiments, a peptide product of Formula III is a product (SEQ. ID. NO. 150)
wherein:
X is comprised of 1-alkyl glucuronic acid or 1-alkyl diglucuronic acid;
Z is NH$_2$;
aa$_1$ is Dmt;
aa$_2$ is Pro, D-Lys(X), Tic, or Tic(Ψ[CH2-NH]);
aa$_3$ is Phe, Tmp, D- or L-Nal(1), D- or L-Nal(2), or Ψ-Phe;
aa$_4$ is Phe, D- or L-Nal(1), D- or L-Nal(2), or Lys(X);
aa$_5$ is absent or Pro, Aib, Lys(X), D- or L-CαMeLys(X).

In some embodiments, a peptide product of Formula III is a product (SEQ. ID. NO. 151)
wherein:
aa$_1$ is Dmt;
aa$_2$ is Pro;
aa$_3$ is Phe, or Tmp;
aa$_4$ is Phe, or Lys(X);
aa$_5$ is absent or Aib, Lys(X), D- or L-CαMeLys(X).

In some embodiments, a peptide product of Formula III is a product (SEQ. ID. NO. 152)
wherein:
aa$_1$ is Dmt;
aa$_2$ is Pro;
aa$_3$ is Phe, or Tmp;
aa$_4$ is Phe, or Lys(X);
aa$_5$ is absent or Lys(X).

In some embodiments, a peptide product of Formula III is a product (SEQ. ID. NO. 153)
wherein:
U is a dibasic natural or unnatural amino acid;
X is a surfactant of the 1-alkyl glycoside class wherein the 1-alkyl group of the 1-alkyl glycoside is substituted or unsubstituted C$_{1-20}$ alkyl or a substituted or unsubstituted alkoxyaryl substituent;
aa$_1$ is Tyr, Dmt, N—R$^3$-Tyr, N—R$^3$-Tyr, N—(R$^3$)$_2$-Tyr, or N—(R$^3$)$_2$-Dmt;
aa$_2$ is D-Arg, D-Cit, or D-U(X);
aa$_3$ is Phe, Trp, D- or L-Nal(1), D- or L-Nal(2), or Tmp;
aa$_4$ is Phe, Tmp, D- or L-Nal(1), D- or L-Nal(2), U(X), D- or L-CαMeU(X);
aa$_5$ is absent, Pro, or U(X).

In some embodiments, a peptide product of Formula III is a product (SEQ. ID. NO. 154)
wherein:
X is a surfactant of the 1-alkyl glucuronic acid or 1-alkyl diglucuronic acid class;
aa$_1$ is Dmt, Nα-Me-Dmt, or N,Nα-Me-Dmt;
aa$_2$ is D-Arg, D-Cit, D-Lys(X), or D-Orn(X);
aa$_3$ is Phe, or Tmp;
aa$_4$ is Phe, Tmp, Lys(X), or Orn(X);
aa$_5$ is absent or Pro, Lys(X), or Orn(X).

In some embodiments, a peptide product of Formula III is a product (SEQ. ID. NO. 155)
wherein:
U is a dibasic natural or unnatural amino acid;
X is a surfactant of the 1-alkyl glycoside class wherein 1-alkyl is substituted or unsubstituted C$_1$-C$_{20}$ alkyl or a substituted or unsubstituted alkoxyaryloxy substituent;
Z is NH$_2$;
aa$_1$ is Tyr, Dmt, N—R$^3$-Tyr, N—R$^3$-Dmt, N—(R$^3$)$_2$-Tyr, or N—(R$^3$)$_2$-Dmt;
aa$_2$ is Tic, or Tic(Ψ[CH2-NH]);
aa$_3$ is Ψ-Phe when aa2 is Tic(Ψ[CH2-NH]);
aa$_4$ is Phe, Tmp, D- or L-Nal(1), D- or L-Nal(2), or U(X);
aa$_5$ is absent, Pro, Aib, or U(X).

In some embodiments, a peptide product of Formula III is a product (SEQ. ID. NO. 156)
wherein:
X is a surfactant of the 1-alkyl glucuronic acid or 1-alkyl diglucuronic acid class;
aa$_1$ is Tyr, Dmt, Nα-Me-Tyr, Nα-alkyl-Dmt, N,Nα-diMe-Tyr, or N,Nα-Me-Dmt;
aa$_2$ is Tic, or Tic(Ψ[CH2-NH]);
aa$_3$ is Ψ-Phe when aa$_2$ is Tic(Ψ[CH2-NH]), Phe, or TMP;
aa$_4$ is Phe, Tmp, D- or L-Nal(1), D- or L-Nal(2), Lys(X), or Orn(X);
aa$_5$ is absent or Aib, Lys(X), or Orn(X).

In some embodiments, a peptide product of Formula III is a product (SEQ. ID. NO. 157)
wherein:
X is comprised of 1-alkyl glucuronic acid or 1-alkyl diglucuronic acid;
aa$_2$ is Tic, or Tic(Ψ[CH2-NH]);
aa$_3$ is Phe or Ψ-Phe;
aa$_4$ is Lys(X);
aa$_5$ is absent.

In some embodiments, a peptide product of Formula III is a product (SEQ. ID. NO. 158)
wherein:
X is comprised of 1-alkyl glucuronic acid;
aa$_2$ is Tic:
aa$_3$ is Phe;
aa$_4$ is Lys(X);
aa$_5$ is absent.

In some embodiments, a peptide product of Formula III is a product (SEQ. ID. NO. 159)
wherein:
X is comprised of a 1-alkyl glucuronic acid selected from 1-methyl beta-D-glucuronic acid, 1-octyl beta-D-glucuronic acid, 1-dodecyl beta-D-glucuronic acid, 1-tetradecyl beta-D-glucuronic acid, 1-hexadecyl beta-D-glucuronic acid, and 1-octadecyl beta-D-glucuronic acid;
aa$_2$ is Tic;
aa$_3$ is Phe;
aa$_4$ is Lys(X);
aa$_5$ is absent.

In some embodiments, a peptide product of Formula III is H-Dmt-Tic-Phe-Lys(N-epsilon-1-methyl beta-D-glucuronyl)-NH$_2$. (SEQ. ID. NO. 78)

In some embodiments, a peptide product of Formula III is H-Dmt-Tic-Phe-Lys(Nepsilon-1-octyl beta-D-glucuronyl)-NH$_2$. (SEQ. ID. NO. 80)

In some embodiments, a peptide product of Formula III is H-Dmt-Tic-Phe-Lys(Nepsilon-1-dodecyl beta-D-glucuronyl)-NH$_2$. (SEQ. ID. NO. 79)

In some embodiments, a peptide product of Formula III is H-Dmt-Tic-Phe-Lys(Nepsilon-1-tetradecyl beta-D-glucuronyl)-NH$_2$. (SEQ. ID. NO. 160)

In some embodiments, a peptide product of Formula III is H-Dmt-Tic-Phe-Lys(Nepsilon-1-hexadecyl beta-D-glucuronyl)-NH$_2$. (SEQ. ID. NO. 82)

In some embodiments, a peptide product of Formula III is H-Dmt-Tic-Phe-Lys(N-epsilon-1-octadecyl beta-D-glucuronyl)-NH$_2$. (SEQ. ID. NO. 83)

In some embodiments, the peptide product is biologically active.

In a specific embodiment, provided herein is a compound selected from compounds of Table 1 in FIG. 1.

Also provided herein is a pharmaceutical composition comprising a therapeutically effective amount of a peptide product of Formula I, II or III, or pharmaceutically acceptable salt thereof, and at least one pharmaceutically acceptable carrier or excipient.

Provided herein is a method of treating pain comprising administration of a therapeutically effective amount of a peptide product of Formula I, II or III or compounds of Table 1 in FIG. 1.

A method for improving the pharmaceutical and medicinal behavior of a peptide, thereby improving its duration of action, bioavailability or its stability in formulation, comprising covalent attachment of a surfactant X to the peptide, wherein X is as described herein.

In some embodiments, a peptide product comprising a covalently linked alkyl glycoside described herein is an analog of Leu-enkephalin. In some of such embodiments, the peptide product contains a covalently linked 1-O-alkyl β-D-glucuronic acid and the peptide is an analog of Leu-enkephalin.

In some embodiments, a peptide product comprising a covalently linked alkyl glycoside described herein is an analog of opioid peptide DPDPE (Akiyama K, et al. (1985) Proc Natl Acad Sci USA 82:2543-7). In some of such embodiments, the peptide product contains a covalently linked 1-O-alkyl glucuronic acid and the peptide is an analog of opioid peptide DPDPE.

In some embodiments, a peptide product comprising a covalently linked alkyl glycoside described herein is an analog of the D-amino acid containing natural product peptides dermorphin (Melchiorri, P. and Negri, L. (1996) Gen Pharmacol 27: 1099-1107) or deltorphin (Erspamer, V., et al. (1989) Proc Natl Acad Sci USA 86:5188-92). In some of such embodiments, the peptide product contains a covalently linked 1-O-alkyl β-D-glucuronic acid and the peptide is an analog of dermorphin or deltorphin.

In some embodiments, a peptide product comprising a covalently linked alkyl glycoside is an analog of endomorphin-1 or -2. In some of such embodiments, the peptide product comprises a covalently linked 1-O-alkyl β-D-glucuronic acid and the peptide is an analog of endomorphin (Lazarus, L. H. and Okada, Y. (2012) Expert Opin Ther Patents 22: 1-14).

In some embodiments, a peptide product comprising a covalently linked alkyl glycoside described herein is an analog of opioid peptide dynorphin (James, I. F., et al. (1982) Life Sci 31:1331-4). In some of such embodiments, the peptide product contains a covalently linked 1-O-alkyl β-D-glucuronic acid and the peptide is an analog of dynorphin.

In some embodiments side chain functional groups of two different amino acid residues are linked to form a cyclic lactam. For example, in some embodiments, a Lys side chain forms a cyclic lactam with the side chain of Glu. In some embodiments such lactam structures are reversed and are formed from a Glu and a Lys. Such lactam linkages in some instances are known to stabilize alpha helical structures in peptides (Condon, S. M., et al. (2002) Bioorg Med Chem 10: 731-736).

In some embodiments side chain functional groups of two different amino acid residues with —SH containing side chains are linked to form a cyclic disulfide. For example, in some embodiments, two penicillamine or two Cys side chains may be linked to constrain the conformation of a peptide (Akiyama K, et al. (1985) Proc Natl Acad Sci USA 82:2543-7) in order to yield greater duration of action or greater receptor selectivity.

In a specific embodiment, the peptide products of Formula I, Formula II or Formula III, described above and herein have the following structure:

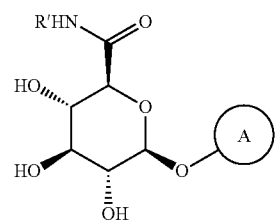

wherein A is a $C_1$-$C_{20}$ alkyl chain as described in Table 1 of FIG. 1, R' is a peptide as described in Table 1 of FIG. 1, $W^2$ of Formula V is —O—, and $W^1$ of Formula V is —(C=O)NH— and is part of an amide linkage to the peptide R'. In some of such embodiments, A is a $C_6$-$C_{20}$ alkyl chain. In some of such embodiments, A is a $C_1$-$C_{10}$ alkyl chain. In some of such embodiments, A is a $C_{12}$-$C_{20}$ alkyl chain. In some of such embodiments, A is a $C_{12}$-$C_{18}$ alkyl chain.

In embodiments described above, an amino moiety of an amino acid and/or a peptide R' (e.g., an amino group of an amino acid residue such as a lysine, or a lysine within the peptide R') is used to form a covalent linkage with a compound of structure:

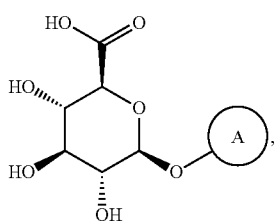

(Formula A)

wherein A is a $C_1$-$C_{20}$ alkyl chain as described above and in Table 1 of FIG. 1.

In such cases, the amino acid residue having an amino moiety (e.g., a Lysine within the peptide R') which is used to form a covalent linkage to the compound of Formula A described above, is a linker amino acid U which is attached to a surfactant X. Accordingly, as one example, Lys(C12) of Table 1 of FIG. 1 has the following structure:

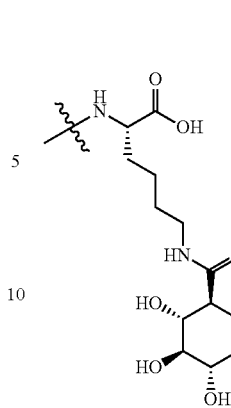

Also contemplated within the scope of the embodiments presented herein are peptide products of Formula I derived from maltouronic acid-based surfactants prepared by covalent linkage of a peptide to either or both carboxylic acid groups. Thus, as one example, peptides in Table 1 of FIG. 1 comprise a lysine linker amino acid bonded to a maltouronic acid based surfactant X and having a structure:

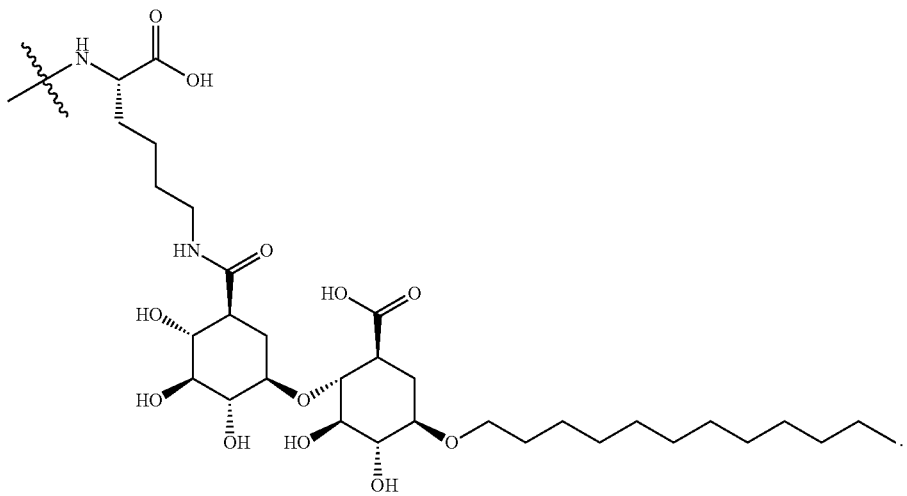

Also contemplated within the scope of the embodiments presented herein are peptide products of Formula I-A derived from melibiouronic acid-based surfactants through binding at the carboxylic acid function. Thus, as one example, peptides in Table 1 of FIG. 1 or Table 2 of FIG. 2 or Table 3 of FIG. 3 comprise a lysine linker amino acid bonded to a melibiouronic acid based surfactant X and having a structure:

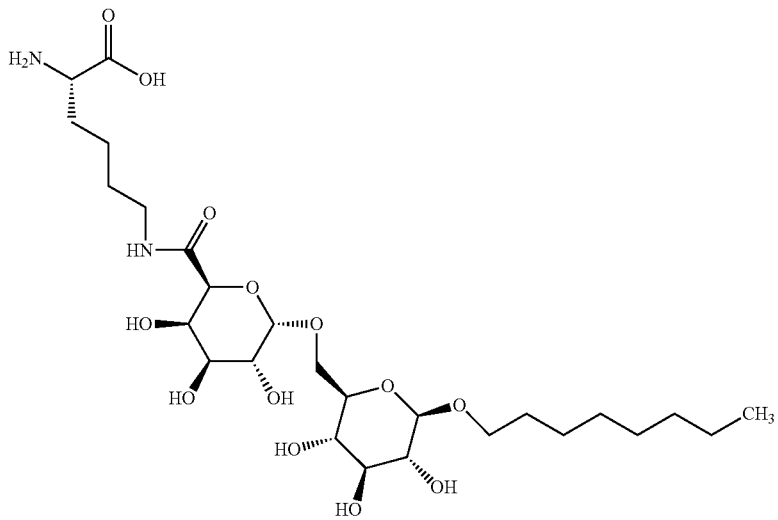 [SMILES: CCCCCCCCO[C@@H]1O[C@H](CO[C@H]2O[C@H](C(=O)NCCCC[C@H](N)C(=O)O)[C@H](O)[C@H](O)[C@H]2O)[C@@H](O)[C@H](O)[C@H]1O]

It will be understood that in one embodiment, compounds of Formula I are prepared by attaching a lysine to a group X, followed by attachment of additional amino acid residues and/or peptides are attached to the lysine-X compound to obtain compounds of Formula I. It will be understood that other natural or non-natural amino acids described herein are also suitable for attachment to the surfactant X and are suitable for attaching additional amino acid/peptides to obtain compounds of Formula I. It will be understood that in another embodiment, compounds of Formula I are prepared by attaching a full length or partial length peptide to a group X, followed by optional attachment of additional amino acid residues and/or peptides are attached to obtain compounds of Formula I.

Also provided herein is a pharmaceutical composition comprising a therapeutically effective amount of a peptide product described above, or acceptable salt thereof, and at least one pharmaceutically acceptable carrier or excipient. In some embodiments, the carrier is an aqueous-based carrier. In some embodiments, the carrier is a nonaqueous-based carrier. In some embodiments, the nonaqueous-based carrier is a hydrofluoroalkane-like solvent comprising sub-micron anhydrous α-lactose, or other excipients.

Contemplated within the scope of embodiments presented herein is the reaction of an amino acid and/or a peptide comprising a linker amino acid U bearing a nucleophile, and a group X comprising a leaving group or a functional group that can be activated to contain a leaving group, for example a carboxylic acid, or any other reacting group, thereby allowing for covalent linkage of the amino acid and/or peptide to a surfactant X via the linker amino acid U to provide a peptide product of Formula I.

Also contemplated within the scope of embodiments presented herein is the reaction of an amino acid and/or a peptide comprising a linker amino acid U bearing a leaving group or a functional group that can be activated to contain a leaving group, for example a carboxylic acid, or any other reacting group, and a group X comprising a nucleophilic group, thereby allowing for covalent linkage of the amino acid and/or peptide to a surfactant X via the linker amino acid U to provide a peptide product of Formula I.

It will be understood that, in one embodiment, Compounds of Formula I are prepared by reaction of a linker amino acid U with X, followed by addition of further residues to U to obtain the peptide product of Formula I. It will be understood that in an alternative embodiment, Compounds of Formula I are prepared by reaction of a suitable peptide comprising a linker amino acid U with X, followed by optional addition of further residues to U, to obtain the peptide product of Formula I.

Further provided herein are certain intermediates and/or reagents that are suitable for synthesis of peptide products described herein. In certain embodiments, such intermediates and/or reagents are functionalized surfactants that allow for covalent linkage with a peptide. In certain embodiments, such intermediates are functionalized 1-alkyl glycoside surfactants that allow for covalent linkage with a peptide. In certain embodiments, such intermediates are functionalized 1-alkyl glycoside surfactants linked to reversibly-protected linker amino acids that allow for covalent linkage with other amino acids to form a peptide. It will be understood that a suitably functionalized surfactant is covalently coupled to a peptide via reaction with an appropriately matched functional group that is on a linker amino acid.

In some embodiments, intermediates suitable for synthesis of peptide products described herein are compounds of Formula IV. Accordingly, provided herein are intermediates and/or compounds of Formula IV:

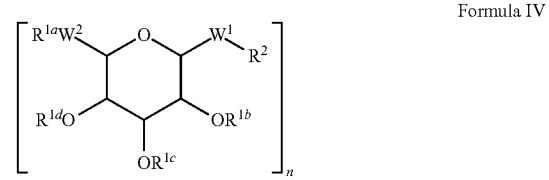

Formula IV wherein:
$R^{1a}$ is independently at each occurrence a bond, H, a protecting group, a natural or unnatural amino acid, a substituted or unsubstituted $C_1$-$C_{30}$ alkyl hydrophobic group, a substituted or unsubstituted alkoxyaryl group, a substituted or unsubstituted aralkyl group, or a steroid nucleus containing moiety;

$R^{1b}$, $R^{1c}$, and $R^{1d}$ are each independently at each occurrence a bond, H, a protecting group, a natural or unnatural amino acid, a substituted or unsubstituted $C_1$-$C_{30}$ alkyl hydrophobic group, a substituted or unsubstituted alkoxyaryl group, or a substituted or unsubstituted aralkyl group;

$W^1$ is —$CH_2$—, —$CH_2$—O—, —(C=O), —(C=O)—O—, —(C=O)—NH—, —(C=S)—, —(C=S)—NH—, or —$CH_2$—S—;

$W^2$ is —O—, —$CH_2$— or —S—;

$R^2$ is H, a protecting group, a natural or unnatural amino acid, a substituted or unsubstituted $C_1$-$C_{30}$ alkyl hydrophobic group, a substituted or unsubstituted alkoxyaryl group, a substituted or unsubstituted aralkyl group, —$NH_2$, $C_2$-$C_4$-alkene, $C_2$-$C_4$-alkyne, —NH(C=O)—$CH_2$—Br, —$(CH_2)_m$-maleimide, or —$N_3$;

n is 1, 2 or 3; and m is 1-10.

In some embodiments, each natural or unnatural amino acid is independently a reversibly protected or free linker amino acid. In some of such embodiments, the linker amino acid is a reversibly protected or free lysine.

In some embodiments of Formula IV, n is 1;

$W^1$ is —(C=O)—;

$R^{1a}$ is a substituted or unsubstituted $C_1$-$C_{30}$ alkyl hydrophobic group, a substituted or unsubstituted 1-alkoxyaryl group, or a substituted or unsubstituted 1-aralkyl group, $R^2$ is a reversibly-protected lysine of D- or L-configuration.

In some embodiments of Formula IV, n is 1;

$W^1$ is —(C=O)—;

$R^{1a}$ is a substituted or unsubstituted $C_8$-$C_{30}$ alkyl hydrophobic group, a substituted or unsubstituted 1-alkoxyaryl group, or a substituted or unsubstituted 1-aralkyl group, $R^2$ is a reversibly protected lysine of D- or L-configuration.

In some of such embodiments, $R^{1a}$ is an octyl, decyl, dodecyl, tetradecyl, or hexadecyl group.

In some embodiments of Formula IV, n is 1;

$W^1$ is —(C=O)—NH— or —(C=O)—O—;

$R^2$ is a substituted or unsubstituted $C_1$-$C_{30}$ alkyl hydrophobic group, a substituted or unsubstituted 1-alkoxyaryl group, or a substituted or unsubstituted 1-aralkyl group, $R^{1a}$ is a reversibly protected serine or threonine of D- or L-configuration.

In some of such embodiments, $R^2$ is an octyl, decyl, dodecyl, tetradecyl or hexadecyl group.

In some embodiments of Formula IV, n is 1;

m is 1-6;

$W^1$ is —$CH_2$—;

$R^{1a}$ is a $C_1$-$C_{30}$ alkyl hydrophobic group, a 1-alkoxyaryl group, or a 1-aralkyl group, $R^2$ is —$N_3$, $NH_2$, —$C_2$-alkyne, —$(CH_2)_m$-maleimide, NH—(C=O)—$CH_2$—Br, or NH—(C=O)—$CH_2$—I.

In some embodiments of Formula IV, n is 1;

$W^1$ is —(C=O)—O—;

$R^2$ is H, $R^{1a}$ is a substituted or unsubstituted $C_1$-$C_{30}$ alkyl hydrophobic group.

In some embodiments of Formula IV, $R^2$ is attached to the peptide or is an amino acid residue in the peptide. In some of such embodiments, $R^2$ is a reversibly protected or free lysine.

In some embodiments of Formula IV, n is 1. In some embodiments of Formula IV, n is 2, and a first glycoside is attached to a second glycoside via a bond between $W^2$ of the first glycoside and any one of $OR^{1b}$, $OR^{1c}$ or $OR^{1d}$ of the second glycoside.

In some embodiments of Formula IV, n is 3, and a first glycoside is attached to a second glycoside via a bond between $W^2$ of the first glycoside and any one of $OR^{1b}$, $OR^{1c}$ or $OR^{1d}$ of the second glycoside, and the second glycoside is attached to a third glycoside via a bond between $W^2$ of the second glycoside and any one of $OR^{1b}$, $OR^{1c}$ or $OR^{1d}$ of the third glycoside.

Provided herein is a method for synthesizing a peptide product described above, comprising sequential steps of (a) coupling a compound of Formula IV to the peptide; and (b) optionally deprotecting the coupled peptide of step (a).

In some embodiments, the deprotecting comprises the use of mild acid and or mild base treatments. In some embodiments of the methods, the deprotecting comprises the use of strong acids.

In some embodiments, the method further comprises the steps of chromatography, desalting of intermediates by reversed-phase, high-performance liquid chromatography or ion exchange chromatography of intermediates.

Provided herein is a method for improving the pharmaceutical and medicinal behavior of a peptide, thereby improving its duration of action, bioavailability or its stability in formulation, comprising covalent attachment of a surfactant X to the peptide, wherein:

X is

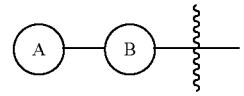

wherein

A is a hydrophobic group; and

B is a hydrophilic group covalently attached to the peptide via a linker amino acid.

In some embodiments, A is a substituted or unsubstituted $C_1$-$C_{30}$ alkyl chain, a substituted or unsubstituted alkoxyaryl group or a substituted or unsubstituted aralkyl group.

In some embodiments, A is a substituted or unsubstituted $C_8$-$C_{20}$ alkyl chain, a substituted or unsubstituted 1-alkoxyaryl group or a substituted or unsubstituted 1-aralkyl group.

In some embodiments, A is a substituted or unsubstituted $C_{10}$-$C_{20}$ alkyl chain, a substituted or unsubstituted 1-alkoxyaryl group or a substituted or unsubstituted 1-aralkyl group.

In some embodiments, B is a functionalized polyol.

In some embodiments, the polyol is a saccharide,

In some embodiments, the saccharide is a monosaccharide, a disaccharide, or a polysaccharide.

In some embodiments, the saccharide is selected from glucuronic acid, galacturonic acid, diglucuronic acid and maltouronic acid.

The methods of synthesis described above are suitable for synthesis of all compounds described herein, including compounds of Formula I, II. III, 2-I-1, 2-III, 2-V, 2-VI, 2-VII, 3-I-A, 3-III-A, 3-III-B, or 3-V, and compounds in Table 1, Table 2, Table 3 and Table 4 provided in FIG. 1, FIG. 2, FIG. 8 and FIG. 9 respectively.

Provided herein is a method for improving the pharmaceutical and medicinal behavior of a peptide, thereby improving its duration of action, bioavailability or its stability in formulation, comprising covalent attachment of a surfactant X to the peptide, wherein:

X is

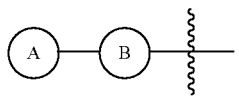

wherein
A is a substituted or unsubstituted $C_1$-$C_{20}$ alkyl chain, a substituted or unsubstituted alkoxyaryl group or a substituted or unsubstituted aralkyl group; and
B is a saccharide covalently attached to the peptide via a linker amino acid.

In some embodiments, the surfactant is a 1-alkyl glycoside class surfactant.

In some embodiments, the hydrophilic group in the surfactant is attached to the peptide via an amide bond.

In some embodiments, the surfactant is composed of 1-hexadecyl-beta-D-glucuronic acid, 1-tetradecyl-beta-D-glucuronic acid, 1-dodecyl-beta-D-glucuronic acid, 1-decyl-beta-D-glucuronic acid, 1-octyl-beta-D-glucuronic acid, 1-hexadecyl-beta-D-diglucuronic acid, 1-tetradecyl-beta-D-diglucuronic acid, 1-dodecyl-beta-D-diglucuronic acid, 1-decyl-beta-D-diglucuronic acid, 1-octyl-beta-D-diglucuronic acid.

Provided herein is a method of treating pain in an individual in need thereof comprising administration of a therapeutically effective amount of a peptide product described herein, or a compound of Formula IV to an individual in need thereof.

Also provided herein is a covalently modified peptide and/or protein product comprising a hydrophilic group as described herein; and a hydrophobic group covalently attached to the hydrophilic group. In specific embodiments, the covalently modified peptide and/or protein product comprises a hydrophilic group that is a saccharide and a hydrophobic group that is a $C_1$-$C_{20}$ alkyl chain or an aralkyl chain.

BRIEF DESCRIPTION OF THE FIGURES

FIG. 1. Table 1 in FIG. 1 depicts compounds that were prepared by methods described herein. The specification provides sequences for SEQ. ID. Nos. 1 and 149-169. Additionally, Table 1 of FIG. 1 provides SEQ. ID Numbers for compounds EU-A101 to EU-A199 and EU-A600 to EU-A649 having SEQ. ID. NOs. 2-148, and SEQ. ID. NO. 645 respectively, as shown in Table 1 of FIG. 1. Compounds in Table 1 of FIG. 1, and their respective SEQ. ID. NOs. shown in Table 1 of FIG. 1 are hereby incorporated into the specification as filed.

FIG. 2. Table 2 in FIG. 2 depicts compounds that were prepared by methods described herein. The specification provides sequences for SEQ. ID. Nos. 170-174 and SEQ. ID. NOs. 283-302. Additionally, Table 2 of FIG. 2 provides SEQ. ID. Numbers for compounds EU-201 to EU-299 and EU-900 to EU-908 having SEQ. ID. NOs. 175-282 respectively, as shown in Table 2 of FIG. 2. Compounds in Table 2 of FIG. 2, and their respective SEQ. ID. NOs. shown in Table 2 of FIG. 2 are hereby incorporated into the specification as filed.

FIG. 8. Table 3 in FIG. 8 depicts compounds that were prepared by methods described herein. The specification provides sequences for SEQ. ID. Nos. 303-305 and SEQ. ID. Nos. 619-644. Additionally, Table 3 of FIG. 8 provides SEQ. ID Numbers for compounds EU-A300 to EU-A425 having SEQ. ID. NOs. 306-431 respectively, as shown in Table 3 of FIG. 8. Compounds in Table 3 of FIG. 8, and their respective SEQ. ID. NOs. shown in Table 3 of FIG. 8 are hereby incorporated into the specification as filed.

FIG. 9. Table 4 in FIG. 9 depicts compounds that were prepared by methods described herein. The specification provides SEQ. ID. Nos. 303-305 and SEQ. ID. Nos. 619-644. Additionally, Table 4 of FIG. 9 provides SEQ. ID Numbers for compounds EU-A426 to EU-A599 having SEQ. ID. NOs. 432-618 respectively, as shown in Table 4 of FIG. 9. Additionally, Table 4 of FIG. 9 provides SEQ. ID Numbers for compounds EU-A700 to EU-A1174 having SEQ. ID. NOs 646-1120. Compounds in Table 4 of FIG. 9, and their respective SEQ. ID. NOs. shown in Table 4 of FIG. 9 are hereby incorporated into the specification as filed.

DETAILED DESCRIPTION OF THE INVENTION

Figure 3:
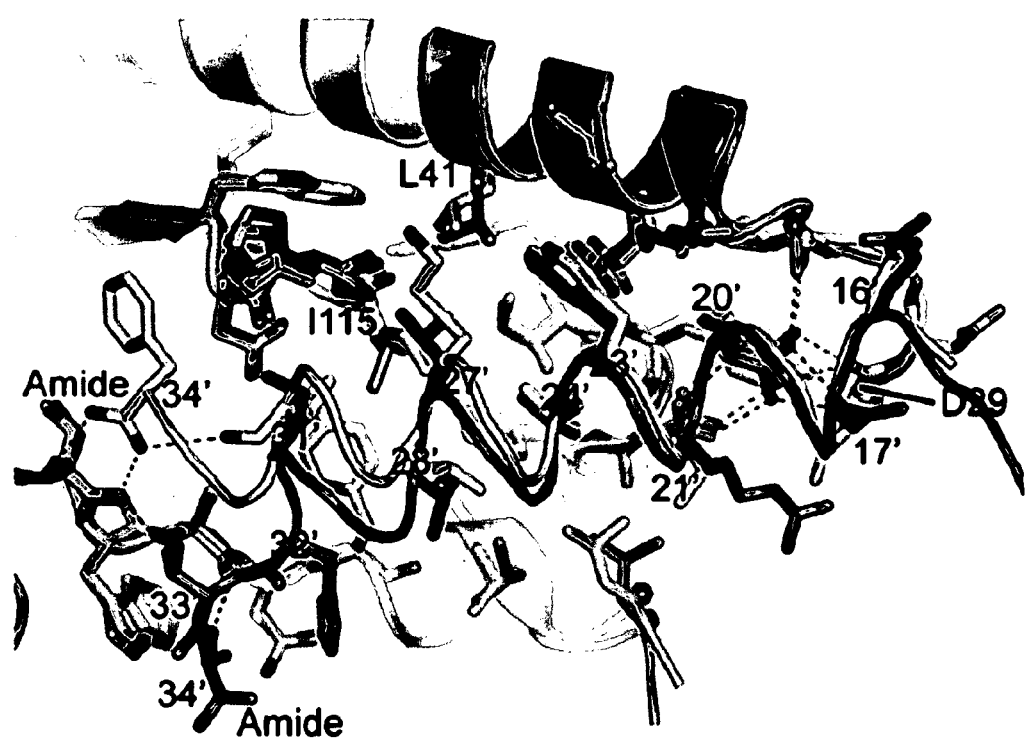
FIG. 3 has two panels. The top panel in FIG. 3 illustrates the interaction between PTH 1-34 or PTHrP 1-34 and the PTH R1 receptor based on the x-ray crystal structure (Piozak, A. A., et al. (2009) J Biol Chem 284:28382-391) of the extracellular domain of the receptor. The critical hydrophobic interactions of residues 23' (W or F), 24' (L) and 28' (L or I) are illustrated. The surfactant modification on the modified peptides described herein, in some instances, replace these critical hydrophobic interactions. The bottom panel in FIG. 3 shows the structural comparison between the sequence of PTH 1-34 and PTHrP 1-34 and illustrates the strong regions of identity and homology in the sequences and peptide helical conformation.

Provided herein are modified peptides and/or proteins that comprise a peptide and/or protein covalently attached to a hydrophilic group, a "head" (e.g., a polyol, (e.g., a saccharide)); the hydrophilic group is covalently attached to a hydrophobic group, a "tail", thereby generating a surfactant. In some embodiments, use of hydrophobic-linked glycoside surfactant (e.g., alkyl glycoside) moieties for covalent modification of the peptides or proteins, prolongs the duration of action of the peptides or proteins by multiple mechanisms, including formation of depots of the drug at the site of administration in the body and binding to hydrophobic carrier proteins. In some embodiments, incorporation of steric hindrance into peptide and/or protein structure can prevent approach of proteases to the peptide and/or protein product and thereby prevent proteolysis. In some embodiments, surfactant modification (e.g., covalent attachment of alkyl glycoside class of surfactants) of peptides and/or proteins as described herein, increases the transport across mucosal barriers. Accordingly, the modifications of the peptides and/or proteins described herein provide desirable benefits including and not limited to, protection from proteolysis, and slowed movement from the site of administration, thereby leading to prolonged pharmacokinetic behavior (e.g., prolongation of circulating $t_{1/2}$) and improved transmucosal bioavailability.

In some embodiments, interaction of the improved peptides and/or proteins with their receptors is modified in beneficial ways by the truncation of the sequence, introduction of constraint, and/or the incorporation of steric hindrance. Described herein are novel alkyl glycoside reagents that allow for incorporation of both rigidity and steric hindrance in the modified peptides and/or proteins. In some embodiments, steric hindrance confers receptor selectivity to the modified peptides and/or proteins described herein. In some embodiments, steric hindrance provides protection from proteolysis.

It has been recognized that activation of G Protein-coupled Receptors (GPCRs) cause the activation of multiple second messanger systems. Activated GPCRs also recruit arrestins, which had been thought to be responsible for stopping GPCR signaling and for internalization of the GPCR. Recently is has been recognized that arrestins themselves are a mediator of various signaling pathways, so that ligands which do not recruit arrestin or which only recruit arrestin can have important biological effects through "biased" signaling (Shenoy, S. K. and Lefkowitz, R. J. (2011) Trends Pharmacolog Sci 32: 521-533). Incorporation of surfactants into the peptides of the invention, with the steric hindrance and altered presentation caused by surfactant modification, may exhibit such surprising and beneficial behavior. Evidence for this behavior is shown by peptides EU-A770 to EU-A773 in example 5.

Proteins and peptides undergo numerous physical and chemical changes that may affect potency and safety. Among these are aggregation, which includes dimerization, trimerization, and the formation of higher-order aggregates such as amyloids. Aggregation is a key issue underlying multiple potentially deleterious effects for peptide and/or protein-based therapeutics, including loss of efficacy, altered pharmacokinetics, reduced stability or product shelf life, and induction of undesirable immunogenicity. Bioavailability and pharmacokinetics of a self-associating peptide can be influenced by aggregate size and the ease of disruption of the non-covalent intermolecular interactions at the subcutaneous site (Maji, S. K., et al. (2008) PLoS Biol 6: e17). In some instances peptides can aggregate into subcutaneous depots that disassociate with $t_{1/2}$ of 30 or more days. Such slow dissolution can lead to favorable effects such as delivery for one month from a single sc injection, causes such a low blood concentration that the peptide appears inactive in vivo. Thus hydrophobic aggregation can appear to totally preclude a peptide's bioavailability and effectiveness (Clodfelter, D. K., et al. (1998) Pharm Res 15: 254-262).

Aggregation has been associated with increased immunogenicity of the administered peptide and/or protein therapeutic. One means to avoid this problem is to work with solutions of lower concentration, however concentrated peptide and protein solutions are desirable in some instances for ease of administration. In some instances, adding polyols (e.g., mono- or oligosaccharides) or alkyl glycosides to the peptide and/or protein solutions during the course of purification and concentration, reduces or eliminates aggregation, providing greater efficiency in the manufacturing process, and providing a final product which has less immunogenic potential.

The FDA and other regulatory agencies have increased their scrutiny of aggregation, especially because of this potential linkage to undesirable immunogenicity. The immunogenicity of a self-associating peptide can be influenced by the formation of aggregates as a result of non-covalent intermolecular interactions. For example, interferon has been shown to aggregate resulting in an antibody response (Hermeling, S., et al. (2006) J Pharm Sci 95: 1084-1096). An antibody response to erythropoietin produced "pure red cell aplasia", a potentially life threatening side effect, in a number of patients receiving recombinant EPO (Casadevall, N., et al. (2002) N Engl J Med 346: 469-475) following a change in formulation that altered the serum albumin source and concentration. Insulin loses activity due to protein aggregation upon agitation at temperatures above those found in refrigerated storage (Pezron, I., et al. (2002) J Pharm Sci 91: 1135-1146, Sluzky, V., et al. (1991) Proc Natl Acad Sci USA 88: 9377-9381). Monoclonal antibody based therapeutics are subject to inactivation as a result of protein aggregation (King, H. D., et al. (2002) J Med Chem 45: 4336-4343). Highly concentrated monoclonal antibody formulations pose stability, manufacturing, and delivery challenges related to the protential of those antibodies to aggregate. Enzymes may also lose activity as a result of aggregation. For example thermal inactivation of urokinase is reported to occur via aggregation (Porter, W. R., et al. (1993) Thromb Res 71: 265-279).

Protein stabilization during lyophilization has also posed problems. Protein therapeutics frequently lose biological activity after lyophilization and reconstitution as a result of aggregate formation and precipitation. In some instances, addition of reconstitution additives (including, for example, sulfated polysaccharides, polyphosphates, amino acids, polyethylene glycol (PEG) and various surfactants (Zhang, M. Z., et al. (1995) Pharm Res 12: 1447-1452, Vrkljan, M., et al. (1994) Pharm Res 11: 1004-1008) reduces aggregation. In some cases, a combination of alcohols, or other organic solvents, is used for solubilization. Trifluoroethanol has an effect on maintaining peptide structure and it has been used in mixtures to stabilize various peptides (Roccatano, D., et al. (2002) Proc Natl Acad Sci USA 99: 12179-12184). There is a danger that such agents may have a harsh effect on mucosal tissue, causing patient discomfort or local toxic effects. U.S. Pat. No. 7,390,788 and U.S. Pat. No. 7,425,542 describe the use of alkyl glycosides as stabilizers because of their gentle, non-ionic detergent-like effect. However covalent incorporation of alkyl glycosides into a peptide and/or protein structure itself has not been described heretofore.

Often naturally occurring oligosaccharides that are covalently attached to proteins do not have surfactant character. In some embodiments, peptide and/or protein products described herein have a covalently attached saccharide and an additional hydrophobic group that confers surfactant character to the modified peptides, thereby allowing for tunability of bioavailability, immunogenicity, and/or pharmacokinetic behavior of the surfactant-modified peptides.

Proteins and peptides modified with oligosaccharides are described in, for example, Jensen, K. J. and Brask, J. (2005) Biopolymers 80: 747-761, through incorporation of saccharide or oligosaccharide structures using enzymatic (Gijsen, H. J., et al. (1996) Chem Rev 96: 443-474; Sears, P. and Wong, C. H. (1998) Cell Mol Life Sci 54: 223-252; Guo, Z. and Shao, N. (2005) Med Res Rev 25: 655-678) or chemical approaches (Urge, L., et al. (1992) Biochem Biophys Res Commun 184: 1125-1132; Salvador, L. A., et al. (1995) Tetrahedron 51: 5643-5656; Kihlberg, J., et al. (1997) Methods Enzymol 289: 221-245; Gregoriadis, G., et al. (2000) Cell Mol Life Sci 57: 1964-1969; Chakraborty, T. K., et al. (2005) Glycoconj J 22: 83-93; Liu, M., et al. (2005) Carbohydr Res 340: 2111-2122; Payne, R. J., et al. (2007) J Am Chem Soc 129: 13527-13536; Pedersen, S. L., et al. (2010) Chembiochem 11: 366-374). Peptides as well as proteins have been modified by glycosylation (Filira, F., et al. (2003) Org Biomol Chem 1: 3059-3063); (Negri, L., et al. (1999) J Med Chem 42: 400-404); (Negri, L., et al. (1998) Br J Pharmacol 124: 1516-1522); Rocchi, R., et al. (1987) Int J Pept Protein Res 29: 250-261; Filira, F., et al. (1990) Int J Biol Macromol 12: 41-49; Gobbo, M., et al. (1992) Int J Pept Protein Res 40: 54-61; Urge, L., et al. (1992) Biochem Biophys Res Commun 184: 1125-1132; Djedaini-Pilard, F., et al. (1993) Tetrahedron Lett 34: 2457-2460; Drouillat, B., et al. (1997) Bioorg Med Chem Lett 7: 2247-2250; Lohof, E., et al. (2000) Angew Chem Int Ed Engl 39: 2761-2764; Gruner, S. A., et al. (2001) Org Lett 3: 3723-3725; Pean, C., et al. (2001) Biochim Biophys Acta 1541: 150-160; Filira, F., et al. (2003) Org Biomol Chem 1: 3059-3063; Grotenbreg, G. M., et al. (2004) J Org Chem 69: 7851-7859; Biondi, L., et al. (2007) J Pept Sci 13: 179-189; Koda, Y., et al. (2008) Bioorg Med Chem 16: 6286-6296; Lowery J. J., et al. (2011) J Pharmacol Exptl Therap 336: 767-78; Yamamoto, T., et al. (2009) J Med Chem 52: 5164-5175).

However, the aforementioned attempts do not describe an additional hydrophobic group attached to the peptide-linked oligosaccharide. Accordingly, provided herein are modified peptides and/or proteins that incorporate a hydrophobic group attached to a saccharide and/or oligosaccharide that is covalently attached to the peptide and/or protein and that allow for tunability of bioavailability, immunogenicity and pharmacokinetic behaviour. Accordingly, also provided herein are surfactant reagents comprising an oligosaccharide and a hydrophobic group, that allow for modification of peptide and/or proteins.

Provided herein is the use of saccharide-based surfactants in covalent linkage to a peptide for improvement of peptide and/or protein properties. In some embodiments, surfactant modification (e.g., covalent attachment of alkyl glycoside class of surfactants) of peptides and/or proteins as described herein, increases the transport across mucosal barriers. In some embodiments, covalent attachment of a surfactant to a peptide and/or protein product prevents aggregation of the peptide and/or protein.

The surfactant-modified peptides and/or proteins described herein overcome limitations of peptide pharmaceuticals including and not limited to short duration of action, poor bioavailability, aggregation, immunogenicity and lack of receptor subtype specificity through the covalent incorporation of surfactants such as alkyl glycosides as novel peptide and protein modifiers.

In certain instances, the effects of surfactants are beneficial with respect to the physical properties or performance of pharmaceutical formulations, but are irritating to the skin and/or other tissues and in particular are irritating to mucosal membranes such as those found in the nose, mouth, eye, vagina, rectum, buccal or sublingual areas. Additionally, in some instances, surfactants denature proteins thus destroying their biological function. Since surfactants exert their effects above the critical micelle concentration (CMC), surfactants with low CMC's are desirable so that they may be utilized with effectiveness at low concentrations or in small amounts in pharmaceutical formulations. Accordingly, in some embodiments, surfactants (e.g., alkyl glycosides) suitable for peptide modifications described herein have the CMC's less than about 1 mM in pure water or in aqueous solutions. By way of example only, certain CMC values for alkyl glycosides in water are: Octyl maltoside 19.5 mM; Decyl maltoside 1.8 mM; Dodecyl-β-D-maltoside 0.17 mM; Tridecyl maltoside 0.03 mM; Tetradecyl maltoside 0.01 mM; Sucrose dodecanoate 0.3 mM. It will be appreciated that a suitable surfactant could have a higher or lower CMC depending on the peptide and/or protein that is modified. As used herein, "Critical Micelle Concentration" or "CMC" is the concentration of an amphiphilic component (alkyl glycoside) in solution at which the formation of micelles (spherical micelles, round rods, lamellar structures etc.) in the solution is initiated. In certain embodiments, the alkyl glycosides dodecyl, tridecyl and tetradecyl maltoside or glucoside as well as sucrose dodecanoate, tridecanoate, and tetradecanoate are possess lower CMC's and are suitable for peptide and/or protein modifications described herein.

Opioid Peptides and Analogs

In some embodiments, a peptide therapeutic class amenable to the methods of peptide modifications described herein is that of the peptide opioids. This class derives from the endogenous peptide opioids which have a very broad range of functions in the body, carried out through binding to the mu (MOR), delta (DOR), and kappa (KOR) opioid receptors (Schiller, P. W. (2005) AAPS J 7: E560-565). Of most interest is their role in modulating and, in particular, suppressing of transmission and perception of pain signals. In the development of such agents the central side effects (respiratory suppression, place preference indicating reward from self administration) are a major concern, so peripherally acting agents would be attractive (Stein, C., et al. (2009) Brain Res Rev 60: 90-113). Studies from a number of labs have suggested that the optimal class of agents will have mu opioid receptor agonism with the possibility of delta receptor antagonism (Schiller, P. W. (2010) Life Sci 86: 598-603).

Although the endomorphins (Janecka, A., et al. (2007) Curr Med Chem 14: 3201-3208) are primarily mu receptor specific, judicious modification of the framework can result in molecules with both mu and delta selectivity (Lazarus, L. H. and Okada, Y. (2012) Expert Opin Ther Patents 22: 1-14; Keresztes, A., et al. (2010) ChemMedChem 5: 1176-96). Derived from the dermorphin family are the DALDA class of analogs (Schiller, P. W. (2010) Life Sci 86: 598-603). Also derived from the dermorphin family are the TIPP family of peptides (Schiller, P. W., et al., (1999) Biopolymers 51:411-25). Described herein are certain opioid peptides that are covalently attached to a saccharide group of an alkyl-glycoside surfactant and have improved pharmaceutical properties.

Some of the exemplary synthetic peptide analogs described herein are derived from endomorphins and some are derived from dermorphin, two classes of native peptide opioid sequences. In one aspect, the present peptide analogs of the native sequences are endorphin related sequences such as illustrated by EU-A101 to EU-A115. In another aspect, the peptide analogs are dermorphin-related sequences such as EU-A107, EU-A108 and EU-A120 to EU-A133. A related class of opioid peptide analogs is illustrated by sequences EU-A134 to EU-A142 wherein a Tic residue replaces the D-Ala residue seen in the dermorphin structure (TIPP family). An additional class of specialized linkage is shown when Tic is replaced by Tic(Ψ[CH2-NH]) as this requires a complementary residue Ψ-Phe to complete the linkage.

In some embodiments, a surfactant-modified peptide product has amino acid sequences corresponding to the general Formula III:

```
                                              (SEQ. ID. NO. 1)
    aa1-aa2-aa3-aa4-aa5-Z  FORMULA III
``` wherein:
aa$_1$ is Tyr, Dmt, N-alkyl-Tyr, N-alkyl-Dmt, N-dialkyl-Tyr, N-dialkyl-Dmt and the like;
aa$_2$ is Pro, D-Arg, D-Cit, D-U(X), D-Ala, Tic, Tic(Ψ[CH2-NH]);
aa$_3$ is Phe, Trp, Tmp, D- or L-Nal(1), D- or L-Nal(2), CαMePhe, W-Phe;
aa$_4$ is Phe, Tmp, D- or L-Nal(1), D- or L-Nal(2), U(X), D- or L-CαMeU(X);
aa$_5$ is absent or Pro, Aib, U(X), D- or L-CαMeU(X)

alkyl or dialkyl is independently a substituted or unsubstituted $C_1$-$C_{10}$ branched or straight chain, or substituted or unsubstituted aralkyl chain;
U is a linking amino acid;
X is a functionalized surfactant linked to the side chain of U;
Z is —OH or NH$_2$.

In some specific embodiments of Formula III, X has the structure:

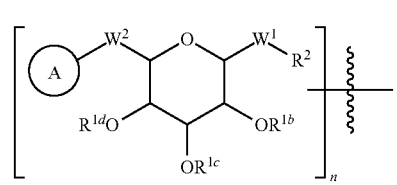

Formula V wherein:
A is a substituted or unsubstituted $C_1$-$C_{30}$ alkyl group;
$R^{1b}$, $R^{1c}$, and $R^{1d}$ are H;
$W^1$ is —(C=O)—NH—;
$W^2$ is —O—; and
$R^2$ is a bond.

In one embodiment, N-alkyl is N-methyl; U is a dibasic amino acid, such as Lys or Orn; X is a modified nonionic detergent of the 1-alkyl glycoside class wherein alkyl is $C_1$-$C_{20}$ alkyl or an alkoxyaryl substituent wherein the glycosidic linkage to the saccharide ring is through —O— or other heteroatom (e.g., S or N); Z is NH$_2$.

In another embodiment, the 1-alkyl group in the 1-alkyl-glycoside is substituted or unsubstituted $C_1$-$C_{16}$alkyl; U is Lys, Z is NH$_2$;
aa$_1$ is Tyr, Dmt, Nα-Me-Tyr, Nα-Me-Dmt;
aa$_2$ is Pro;
aa$_3$ is Phe, Trp, Tmp;
aa$_4$ is Phe, Lys(X);
aa$_5$ is absent or Lys(X).

In a further embodiment, 1-alkyl group in the 1-alkylglycoside is substituted or unsubstituted $C_1$-$C_{20}$alkyl; Z is NH$_2$;
aa$_1$ is Tyr, Dmt;
aa$_2$ is D-Arg, D-Lys(X), Tic, Tic(Ψ[CH2-NH]);
aa$_3$ is Phe, Trp, Tmp, CαMePhe, W-Phe;
aa$_4$ is Phe, Tmp, Lys(X);
aa$_5$ is absent or Pro, Aib, Lys(X), D- or L-CαMeLys(X).

The endomorphin class parent structures are:
Endomorphin 1—Tyr-Pro-Trp-Phe-NH2
Endomorphin 2—Tyr-Pro-Phe-Phe-NH2
Certain analog family substitutions are as shown below:

| Position 1 | Position 2 | Position 3 | Position 4 | Position 5 |
|---|---|---|---|---|
| Tyr | Pro | Phe | Phe | —NH2 |
| Dmt | | Trp | Tmp | Lys(X)-NH2 |
| N-Alkyl-Tyr | | Tmp | Lys(X) | Aib-NH2 |
| N-Alkyl-Dmt | | CαMePhe | CαMeLys(X) | Pro-NH2 |
| N-dialkyl-Tyr | | D- or L-Nal(1) | Pro | |
| N-dialkyl-Dmt | | D- or L-Nal(2) | | |

X = 1-alkyl glucuronyl or 1-alkyl mannouronyl substituted with 1-($C_1$-$C_{20}$ alkyl, aryloxyalkyl, and the like)

Certain sequences contain the following amino acids:

| Position 1 | Position 2 | Position 3 | Position 4 | Position 5 |
|---|---|---|---|---|
| Tyr | Pro | Phe | Phe | —NH2 |
| Dmt |  | Trp | Tmp | Lys(X)-NH2 |
|  |  | Tmp | Lys(X) |  |

X = 1-alkyl glucuronyl or 1-alkyl mannouronyl substituted with 1-($C_1$-$C_{20}$ alkyl, aryloxy-alkyl, and the like)

In specific embodiments, analogs with attached surfactants include and are not limited to:

|  | Position 1 | Position 2 | Position 3 | Position 4 |
|---|---|---|---|---|
| EU-A101 | Dmt | Pro | Tmp | Lys(C1-glucuronyl)-NH2 |
| EU-A102 | Dmt | Pro | Tmp | Lys(C8-glucuronyl)-NH2 |
| EU-A103 | Dmt | Pro | Tmp | Lys(C12-glucuronyl)-NH2 |
| EU-A105 | Dmt | Pro | Tmp | Phe-Lys(C1-glucuronyl)-NH2 |
| EU-A106 | Dmt | Pro | Tmp | Phe-Lys(C12-glucuronyl)-NH2 |
| EU-A162 | Dmt | Pro | Phe | Lys(C1-glucuronyl)-NH2 |
| EU-A163 | Dmt | Pro | Phe | Lys(C8-glucuronyl)-NH2 |
| EU-A164 | Dmt | Pro | Phe | Lys(C12-glucuronyl)-NH2 |
| EU-A189 | Dmt | Pro | Phe | Phe-Lys(C1-glucuronyl)-NH2 |
| EU-A190 | Dmt | Pro | Phe | Phe-Lys(C12-glucuronyl)-NH2 |

X = 1-alkyl glucuronyl or 1-alkyl mannouronyl substituted with 1-($C_1$-$C_{20}$ alkyl, aryloxy-alkyl, and the like)

The Dermorphin class parent structure is:
Parent dermorphin—Tyr-D-Ala-Phe-Gly-Tyr-Pro-Ser-NH2

Certain analog family structures are as shown below:

| Position 1 | Position 2 | Position 3 | Position 4 |  |
|---|---|---|---|---|
| Tyr | D-Arg | Phe | Phe | NH2 |
| Dmt | D-Lys(X) | Trp | Tmp | Lys(X)-NH2 |
| N-Alkyl-Tyr | D-Ala | Tmp | Lys(X) | Pro-NH2 |
| N-Alkyl-Dmt | Tic | CαMePhe | CαMeLys(X) | Aib-NH2 |
| N-dialkyl-Tyr | Tic-(Ψ[$CH_2$—NH]) | Ψ-Phe |  |  |
| N-dialkyl-Dmt |  | D- or L-Nal(1) | D- or L-Nal(1) | D- or L-Nal(1) |
|  |  | D-or L-Nal(2) | D- or L-Nal(2) | D- or L-Nal(2) |

X = 1-alkyl glucuronyl or 1-alkyl mannouronyl substituted with 1-($C_1$-$C_{20}$ alkyl, aryloxy-alkyl, and the like)

In some embodiments, certain analogs suitable for attachment of surfactants include and are not limited to:

| Position 1 | Position 2 | Position 3 | Position 4 |  |
|---|---|---|---|---|
| Tyr | D-Arg | Phe | Phe | NH2 |
| Dmt | D-Lys(X) | Trp | Tmp | Lys(X)-NH2 |
|  | Tic | Tmp | Lys(X) | Pro-NH2 |
|  | Tic-(Ψ[$CH_2$—NH]) | Ψ-Phe |  | Aib-NH2 |
|  |  | CαMePhe |  |  |
|  |  | D- or L-Nal(1) | D- or L-Nal(1) |  |
|  |  | D- or L-Nal(2) | D- or L-Nal(2) |  |

X = 1-alkyl glucuronyl or 1-alkyl mannouronyl substituted with 1-($C_1$-$C_{20}$ alkyl, aryloxy-alkyl, and the like)

In specific embodiments, analogs suitable for attachment of surfactants include and are not limited to:

|  | Position 1 | Position 2 | Position 3 | Position 4 |
|---|---|---|---|---|
| EU-A107 | Dmt | D- Lys(C1-glucuronyl) | Tmp | Phe-NH2 |
| EU-A108 | Dmt | D- Lys(C12-glucuronyl) | Tmp | Phe-NH2 |
| EU-A120 | Dmt | D- Lys(C8-glucuronyl) | Nal(1) | Phe-NH2 |
| EU-A121 | Dmt | D- Lys(C12-glucuronyl) | Nal(1) | Phe-NH2 |
| EU-A122 | Dmt | D- Lys(C16-glucuronyl) | Nal(1) | Phe-NH2 |
| EU-A123 | Dmt | D- Lys(C18-glucuronyl) | Nal(1) | Phe-NH2 |
| EU-A124 | Dmt | D- Lys(C20-glucuronyl) | Nal(1) | Phe-NH2 |
| EU-A125 | Dmt | D- Lys(C22-glucuronyl) | Nal(1) | Phe-NH2 |
| EU-A126 | Dmt | D- Lys(C24-glucuronyl) | Nal(1) | Phe-NH2 |
| EU-A178 | Dmt | Tic | Phe | Lys(C1-glucuronyl)-NH2 |
| EU-A179 | Dmt | Tic | Phe | Lys(C12-glucuronyl)-NH2 |
| EU-A180 | Dmt | Tic | Phe | Lys(C8-glucuronyl)-NH2 |
| EU-A181 | Dmt | Tic | Phe | Lys(C10-glucuronyl)-NH2 |
| EU-A182 | Dmt | Tic | Phe | Lys(C16-glucuronyl)-NH2 |
| EU-A183 | Dmt | Tic | Phe | Lys(C18-glucuronyl)-NH2 |
| EU-A184 | Dmt | Tic | Phe | Lys(C20-glucuronyl)-NH2 |
| EU-A189 | Dmt | Tic | Phe | Phe-Lys(C1-glucuronyl)-NH2 |
| EU-A190 | Dmt | Tic | Phe | Phe-Lys(C12-glucuronyl)-NH2 |
| EU-A191 | Dmt | Tic | Phe | Phe-Lys(C8-glucuronyl)-NH2 |
| EU-A600 | Dmt | Tic | Phe | Lys(C1-glucuronyl)-Aib-NH2 |
| EU-A601 | Dmt | Tic | Phe | Lys(C8-glucuronyl)-Aib-NH2 |
| EU-A603 | Dmt | Tic | Phe | Lys(C12-glucuronyl)-Aib-NH2 |
| EU-A615 | Dmt | Tic | Phe | D-Lys(C1-glucuronyl)-Aib-NH2 |
| EU-A616 | Dmt | Tic | Phe | D-Lys(C8-glucuronyl)-Aib-NH2 |

| | Position 1 | Position 2 | Position 3 | Position 4 |
|---|---|---|---|---|
| EU-A618 | Dmt | Tic | Phe | D-Lys(C12-glucuronyl)-NH2 |
| EU-A619 | Dmt | Tic | Phe | D-Lys(C16-glucuronyl)-NH2 |
| EU-A620 | Dmt | Tic | Phe | Lys(C1-glucuronyl)-NHCH$_2$Ph |
| EU-A621 | Dmt | Tic | Phe | Lys(C8-glucuronyl)-NHCH$_2$Ph |
| EU-A623 | Dmt | Tic | Phe | Lys(C12-glucuronyl)-NHCH$_2$Ph |
| EU-A624 | Dmt | Tic | Phe | Lys(C16-glucuronyl)-NHCH$_2$Ph |
| EU-A639 | Dmt | Tic | Phe | D-Lys(C1-glucuronyl)-NHCH$_2$Ph |
| EU-A642 | Dmt | Tic | Phe | D-Lys(C12-glucuronyl)-NHCH$_2$Ph |
| EU-A648 | Dmt | Tic | Phe | Lys(C16-glucuronyl)-NH$_2$ |
| EU-649 | Dmt | Tic | Phe | Lys(C14-glucuronyl)-NH$_2$ |

X = 1-alkyl glucuronyl or 1-alkyl mannouronyl substituted with 1-(C$_1$-C$_{20}$ alkyl, aryloxyalkyl, and the like)

Contemplated within the scope of embodiments presented herein are peptide chains substituted in a suitable position by the substitution of the analogs claimed herein by acylation on a linker amino acid, at for example, the ε-position of Lys, with fatty acids such as octanoic, decanoic, dodecanoic, tetradecanoic, hexadecanoic, octadecanoic, 3-phenylpropanoic acids and the like, with saturated or unsaturated alkyl chains (Nestor, J. J., Jr. (2009) Current Medicinal Chemistry 16: 4399-4418; Zhang, L and Bulaj, G. (2012) Curr Med Chem 19: 1602-18). Non-limiting, illustrative examples of such analogs are:

```
                             (SEQ. ID. NO. 161)
H-Dmt-Tic-Phe-Lys(N-epsilon-acetyl)-NH2, (SEQ. ID. NO. 162)
H-Dmt-Tic-Phe-Lys(N-epsilon-dodecanoyl)-NH2, (SEQ. ID. NO. 163)
H-Dmt-Tic-Phe-Lys(N-epsilon-tetradecanoyl)-NH2, (SEQ. ID. NO. 164)
H-Dmt-Tic-Phe-Lys(N-epsilon-(gamma-glutamyl)-N- alpha-dodecanoyl))-NH2, (SEQ. ID. NO. 165)
H-Dmt-Tic-Phe-Lys(N-epsilon-(gamma-glutamyl)-N- alpha-tetradecanoyl))-NH2, (SEQ. ID. NO. 166)
H-Dmt-Tic-Phe-Lys(N-epsilon-acetyl)-NH-benzyl, (SEQ. ID. NO. 167)
H-Dmt-Tic-Phe-Lys(N-epsilon-dodecanoyl)-NH-benzyl, and the like.
```

In other embodiments of the invention the peptide chain may be substituted in a suitable position by reaction on a linker amino acid, for example the sulfhydryl of Cys, with a spacer and a hydrophobic moiety such as a steroid nucleus, for example a cholesterol moiety. In some of such embodiments, the modified peptide further comprises one or more PEG chains. Non-limiting examples of such molecules are:

```
                             (SEQ. ID. NO. 168)
H-Dmt-Tic-Phe-Cys(S-(3-(PEG4-aminoethylacetamidecholesterol)))-NH2, (SEQ. ID. NO. 169)
H-Dmt-Tic-Phe-Cys(S-(3-(PEG4-aminoethylacetamidecholesterol)))-NH-benzyl, and the like.
```

The compounds of Formula I, Formula II, or Formula III are assayed for mu opioid receptor activity in a cellular assay (MOP in agonist and antagonist mode), and for delta2 opioid receptor activity in cellular assay (DOP in agonist and antagonist mode) as described in Example 12.

In certain embodiments, as shown in Example 12, a compound having a pure MOP agonist activity along with a pure DOP antagonistic activity, is a suitable profile for clinical applications. Also contemplated within the scope of the disclosure herein are compounds that have low solubility and low apparent in vitro potency but exhibit prolonged duration of action (pharmacodynamic action) in vivo.

Contemplated within the scope of embodiments presented herein are peptide products of Formula I, Formula II or Formula III, wherein the peptide product comprises one, or, more than one surfactant groups (e.g., group X having the structure of Formula I). In one embodiment, a peptide product of Formula I, Formula II or Formula III, comprises one surfactant group. In another embodiment, a peptide product of Formula I, Formula II or Formula III, comprises two surfactant groups. In yet another embodiment, a peptide product of Formula I, Formula II or Formula III, comprises three surfactant groups.

PTH Peptides and Analogs

Also provided herein, in some embodiments, are reagents and intermediates for synthesis of modified peptides and/or proteins (e.g., modified PTH, PTHrP, or the like) through the incorporation of surfactants.

Provided herein, in some embodiments, are peptide products comprising a surfactant X, covalently attached to a peptide, the peptide comprising a linker amino acid U and at least one other amino acid:

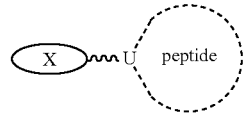

Formula 2-I-A wherein the surfactant X is a group of Formula 2-I:

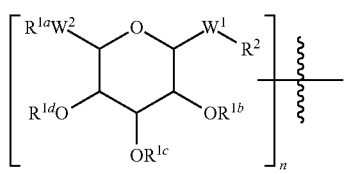

Formula 2-I wherein:
R$^{1a}$ is independently, at each occurrence, a bond, H, a substituted or unsubstituted C$_1$-C$_{30}$ alkyl group, a substituted or unsubstituted alkoxyaryl group, a substituted or unsubstituted aralkyl group, or a steroid nucleus containing moiety;
R$^{1b}$, R$^{1c}$, and R$^{1d}$ are each, independently at each occurrence, a bond, H, a substituted or unsubstituted C$_1$-C$_{30}$ alkyl group, a substituted or unsubstituted alkoxyaryl group, or a substituted or unsubstituted aralkyl group;
W$^1$ is independently, at each occurrence, —CH$_2$—, —CH$_2$—O—, —(C=O)—, —(C=O)—O—, —(C=O)—NH—, —(C=S)—, —(C=S)—NH—, or —CH$_2$—S—;
W$^2$ is —O—, —CH$_2$—, or —S—;
R$^2$ is independently, at each occurrence, a bond, H, a substituted or unsubstituted C$_1$-C$_{30}$ alkyl group, a substituted or unsubstituted alkoxyaryl group, or a substituted or unsubstituted aralkyl group, —NH$_2$, —SH, C$_2$-C$_4$-alkene, C$_2$-C$_4$-alkyne, —NH(C=O)—CH$_2$—Br, —(CH$_2$)$_m$-maleimide, or —N$_3$;
n is 1, 2 or 3; and
m is 1-10;
the peptide is selected from Formula 2-II:

(SEQ. ID. NO. 170)
aa$_1$-Val$_2$-aa$_3$-Glu$_4$-aa$_5$ aa$_6$-aa$_7$-aa$_8$-His$_9$-aa$_{10}$-aa$_{11}$- aa$_{12}$-aa$_{13}$-aa$_{14}$-aa$_{15}$-aa$_{16}$-aa$_{17}$-aa$_{18}$-aa$_{19}$-aa$_{20}$-aa$_{21}$- aa$_{22}$-aa$_{23}$-aa$_{24}$-aa$_{25}$-aa$_{26}$-Z   Formula 2-II wherein:
Z is OH, or —NH—R$^3$,
R$^3$ is H, a substituted or unsubstituted C$_1$-C$_{12}$ alkyl, or a PEG chain of less than 10 Da;
aa$_1$ is Aib, Ac5c, or Deg;
aa$_3$ is Aib, Ac4c, or Deg;
aa$_5$ is His, or Ile;
aa$_6$ is Gln, or Cit;
aa$_7$ is Leu, or Phe;
aa$_8$ is Leu, or Nle;
aa$_{10}$ is Asp, Asn, Gln, Glu, Cit, Ala, or Aib;
aa$_{11}$ is Arg, or hArg;
aa$_{12}$ is Gly, Glu, Lys, Ala, Aib, or Ac5c;
aa$_{13}$ is Lys, or Arg;
aa$_{14}$ is Ser, His, Trp, Phe, Leu, Arg, Lys, Glu, or Nal(2);
aa$_{15}$ is Ile, Leu, or Aib;
aa$_{16}$ is Gln, Asn, Glu, Lys, Ser, Cit, Aib, or U;
aa$_{17}$ is Asp, Ser, Aib, Ac4c, Ac5c, or U;
aa$_{18}$ is absent or Leu, Gln, Cit, Aib, Ac5c, Lys, Glu or U;
aa$_{19}$ is absent or Arg, Glu, Aib, Ac4c, Ac5c, or U;
aa$_{20}$ is absent or Arg, Glu, Lys, Aib, Ac4c, Ac5c, or U;
aa$_{21}$ is absent or Arg, Val, Aib, Ac5C, Deg, or U;
aa$_{22}$ is absent or Phe, Glu, Aib, Ac5C, Lys, or U;
aa$_{23}$ is absent or Leu, Phe, Trp, or U;
aa$_{24}$ is absent or His, Arg, or U;
aa$_{25}$ is absent or His, Lys, or U and
aa$_{26}$ is absent or Aib, Ac5c, Lys;
U is a natural or unnatural amino acid comprising a functional group used for covalent attachment to the surfactant X;
wherein any two of aa$_1$-aa$_{26}$ are optionally cyclized through their side chains to form a lactam linkage; and
provided that one, or at least one of aa$_{16}$-aa$_{26}$ is the linker amino acid U covalently attached to X.

In some embodiments, n is 1. In some embodiments, n is 2, and a first glycoside is attached to a second glycoside via a bond between W$^2$ of the first glycoside and any one of OR$^{1b}$, OR$^{1c}$ or OR$^{1d}$ of the second glycoside. In some embodiments, n is 3, and a first glycoside is attached to a second glycoside via a bond between W$^2$ of the first glycoside and any one of OR$^{1b}$, OR$^{1c}$ or OR$^{1d}$ of the second glycoside, and the second glycoside is attached to a third glycoside via a bond between W$^2$ of the second glycoside and any one of OR$^{1b}$, OR$^{1c}$ or OR$^{1d}$ of the third glycoside.

In one embodiment, compounds of Formula I-A are compounds wherein X has the structure:

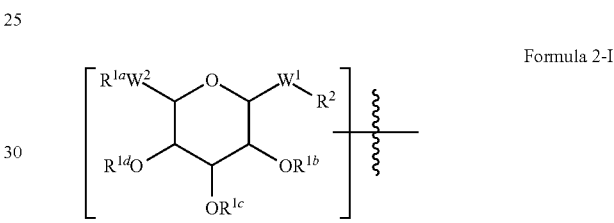

Formula 2-I wherein:
R$^{1a}$ is H, a protecting group, a substituted or unsubstituted C$_1$-C$_{30}$ alkyl group, or a steroid nucleus containing moiety;
R$^{1b}$, R$^{1c}$, and R$^{1d}$ are each, independently at each occurrence, H, a protecting group, or a substituted or unsubstituted C$_1$-C$_{30}$ alkyl group;
W$^1$ is independently, at each occurrence, —CH$_2$—, —CH$_2$—O—, —(C=O)—, —(C=O)—O—, —(C=O)—NH—, —(C=S)—, —(C=S)—NH—, or —CH$_2$—S—;
W$^2$ is —O— or —S—;
R$^2$ is a bond, C$_2$-C$_4$-alkene, C$_2$-C$_4$-alkyne, or —(CH$_2$)$_m$-maleimide; and
m is 1-10.

In another embodiment, compounds of Formula I-A are compounds wherein X has the structure:

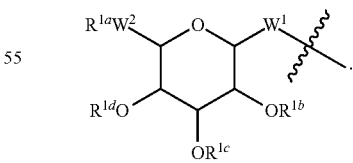

Accordingly, in the embodiment described above, R$^2$ is a bond.

For instance, in an exemplary embodiment of the structure of X described above, W$^1$ is —C(=O)NH—, R$^2$ is a bond between W$^1$ and an amino acid residue U within the peptide (e.g., an amino group in the sidechain of a lysine residue present in the peptide).

In a further embodiment, compounds of Formula I-A are compounds wherein X has the structure:

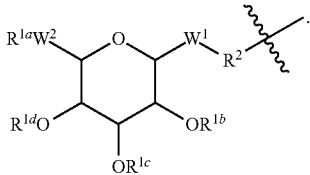

For instance, in an exemplary embodiment of the structure of X described above, $W^1$ is —$CH_2$— and $R^2$ is an alkyl-linked maleimide functional group on X and $R^2$ is attached to a suitable moiety of an amino acid residue U within the peptide (e.g., a thiol group in a cysteine residue of the peptide forms a thioether with the maleimide on X).

In yet another embodiment, compounds of Formula I-A are compounds wherein X has the structure:

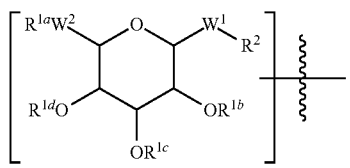

Formula 2-I wherein:
$R^{1a}$ is H, a protecting group, a substituted or unsubstituted $C_1$-$C_{30}$ alkyl group, or a steroid nucleus containing moiety;
$R^{1b}$, $R^{1c}$, and $R^{1d}$ are each, independently at each occurrence, H, a protecting group, or a substituted or unsubstituted $C_1$-$C_{30}$ alkyl group;
$W^1$ is —(C=O)—NH—;
$W^2$ is —O—;
$R^2$ is a bond.

In an additional embodiment, compounds of Formula I-A are compounds wherein X has the structure:

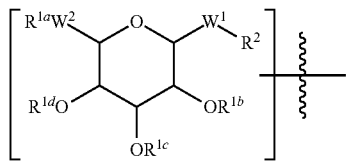

Formula 2-I wherein:
$R^{1a}$ is a substituted or unsubstituted $C_1$-$C_{30}$ alkyl group;
$R^{1b}$, $R^{1c}$, and $R^{1d}$ are H;
$W^1$ is —(C=O)—NH—;
$W^2$ is —O—; and
$R^2$ is a bond.

In some embodiments described above and herein, $R^{1a}$ is a substituted or unsubstituted $C_1$-$C_{30}$ alkyl group.

In some embodiments described above and herein, $R^{1a}$ is a substituted or unsubstituted $C_6$-$C_{20}$ alkyl group.

Also contemplated herein are alternate embodiments wherein X in Formula 2-I-A has the structure:

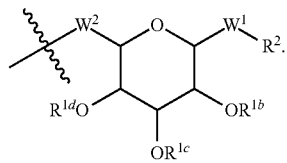

For instance, in an exemplary embodiment of the structure of X described above, $W^1$ is —S—, $R^2$ is a $C_1$-$C_{30}$ alkyl group, $W^2$ is S, $R^{1a}$ is a bond between $W^2$ and a suitable moiety of an amino acid residue U within the peptide (e.g., a thiol group in a cysteine residue of the peptide forms a thioether with X).

In another exemplary alternate embodiment of the structure of X described above, $W^1$ is —O—, $R^2$ is a $C_1$-$C_{30}$ alkyl group, $W^2$ is O, $R^{1a}$ is a bond between $W^2$ and a suitable moiety of an amino acid residue U within the peptide (e.g., a hydroxyl group in a serine or threonine residue of the peptide forms an ether with X).

In some embodiments, U is used for covalent attachment to X and is a dibasic natural or unnatural amino acid, a natural or unnatural amino acid comprising a thiol, an unnatural amino acid comprising a —$N_3$ group, an unnatural amino acid comprising an acetylenic group, or an unnatural amino acid comprising a —NH—C(=O)—$CH_2$—Br or a —$(CH_2)_m$-maleimide, wherein m is 1-10.

In some embodiments of the peptide product, the surfactant is a 1-alkyl glycoside class surfactant. In some embodiments of the peptide product, the surfactant is attached to the peptide via an amide bond.

In some embodiments of the peptide product, the surfactant X is comprised of 1-eicosyl beta-D-glucuronic acid, 1-octadecyl beta-D-glucuronic acid, 1-hexadecyl beta-D-glucuronic acid, 1-tetradecylbeta D-glucuronic acid, 1-dodecyl beta D-glucuronic acid, 1-decyl beta-D-glucuronic acid, 1-octyl beta-D-glucuronic acid, 1-eicosyl beta-D-diglucuronic acid, 1-octadecyl beta-D-diglucuronic acid, 1-hexadecyl beta-D-diglucuronic acid, 1-tetradecyl beta-D-diglucuronic acid, 1-dodecyl beta-D-diglucuronic acid, 1-decyl beta-D-diglucuronic acid, 1-octyl beta-D-diglucuronic acid, or functionalized 1-ecosyl beta-D-glucose, 1-octadecyl beta-D-glucose, 1-hexadecyl beta-D-glucose, 1-tetradecyl beta-D-glucose, 1-dodecyl beta-D-glucose, 1-decyl beta-D-glucose, 1-octyl beta-D-glucose, 1-eicosyl beta-D-maltoside, 1-octadecyl beta-D-maltoside, 1-hexadecyl beta-D-maltoside, 1-dodecyl beta-D-maltoside, 1-decyl beta-D-maltoside, 1-octyl beta-D-maltoside, and the like, and the peptide product is prepared by formation of a linkage between the aforementioned groups and a group on the peptide (e.g., a —COOH group in the aforementioned groups and an amino group of the peptide).

In some embodiments of the peptide product, U is a terminal amino acid of the peptide. In some embodiments of the peptide product, U is a non-terminal amino acid of the peptide. In some embodiments of the peptide product, U is a natural D- or L-amino acid. In some embodiments of the peptide product, U is an unnatural amino acid. In some embodiments of the peptide product, U is selected from Lys, Cys, Orn, or an unnatural amino acid comprising a functional group used for covalent attachment to the surfactant X.

In some embodiments of the peptide product, the functional group used for covalent attachment of the peptide to the surfactant X is —NH$_2$, —SH, —OH, —N$_3$, haloacetyl, a —(CH$_2$)$_m$-maleimide (wherein m is 1-10), or an acetylenic group.

In some embodiments side chain functional groups of two different amino acid residues are linked to form a cyclic lactam. For example a Lys$_{14}$ side chain may form a cyclic lactam with the side chain of Glu$_{18}$ or a Lys$_{18}$ may form a lactam with the side chain of a Glu$_{22}$. In some embodiments such lactam structures are reversed and are formed from a Glu$_{14}$ and a Lys$_{18}$, for example. Such lactam linkages, in some instances, stabilize alpha helical structures in peptides (Condon, S. M., et al. (2002) Bioorg Med Chem 10: 731-736).

In some embodiments, the peptide product comprising a covalently linked alkyl glycoside is a covalently modified PTH or analog thereof. In some of such embodiments, the peptide product contains a covalently linked 1-O-alkyl β-D-glucuronic acid and the peptide is an analog of PTH.

In some embodiments, a peptide product comprising a covalently linked alkyl glycoside is a covalently modified PTHrP, or analog thereof. In some of such embodiments, the peptide product comprises a covalently linked 1-O-alkyl β-D-glucuronic acid and the peptide is an analog of PTHrP.

In some embodiments, the peptide product has the structure of Formula 2-III:

```
                                            (SEQ. ID. NO. 171)
aa1-Val2-Aib3-Glu4-Ile5-Gln6-Leu7-Nle8-His9-Gln10- hArg11-aa12-Arg13-aa14-Ile15-aa16-aa17-aa18- aa19-aa20-aa21-aa22-aa23-aa24-aa25-aa26-Z

Formula 2-III
``` wherein:

Z is OH or —NH$_2$;

aa$_1$ is Aib, or Ac5c;

aa$_{12}$ is Ala, Glu, Lys, Aib, or Ac5c;

aa$_{14}$ is Trp, Phe, Lys, Glu or Nal(2);

aa$_{16}$ is Gln, Asn, Glu, Lys, Cit, or U(X);

aa$_{17}$ is Asp, Ser, Aib, Ac4c, Ac5C or U(X);

aa$_{18}$ is absent or Leu, Gln, Aib, Lys, Glu or U(X);

aa$_{19}$ is absent or Arg, Glu, Aib, Ac4c or Ac5c;

aa$_{20}$ is absent or Arg, Glu, Lys, Aib, Ac4c, Ac5c;

aa$_{21}$ is absent or Arg, Val, Aib, Ac5C, or Deg;

aa$_{22}$ is absent or Phe, Glu, Lys or U(X);

aa$_{23}$ is absent or Leu, Phe, Trp or U(X);

aa$_{24}$ is absent or His, Arg, or U(X);

aa$_{25}$ is absent or His, Lys, or U(X); and aa$_{26}$ is absent or Aib, Ac5c;

wherein any two of aa$_1$-aa$_{26}$ are optionally cyclized through their side chains to form a lactam linkage; and provided that one, or at least one of aa$_{16}$, aa$_{17}$, aa$_{18}$, aa$_{22}$, aa$_{23}$, aa$_{24}$ or aa$_{25}$ is the linker amino acid U covalently attached to X.

In some embodiments of Formula 2-III, U is any linker amino acid described herein. In some embodiments, the compound of Formula 2-III is a compound wherein aa$_{12}$ and aa$_{16}$ are cyclized through their side chains to form a lactam linkage. In some embodiments, the compound of Formula 2-III is a compound wherein aa$_{16}$ and aa$_{20}$ are cyclized through their side chains to form a lactam linkage.

In some embodiments, the peptide product has the structure:

```
                                            (SEQ. ID. NO. 180)
Ac5c1-Val2-Aib3-Glu4-Ile5-Gln6-Leu7-Nle8-His9-

Gln10-hArg11-Ala12-Arg13-Trp14-Ile15-Gln16-Aib17-

Lys(N-epsilon-1'-dodecyl beta-D- glucuronyl)18-NH2.
```

In some embodiments, the peptide product has the structure:

```
                                            (SEQ. ID. NO. 283)
Ac5c1-Val2-Aib3-Glu4-Ile5-Gln6-Leu7-Nle8-His9-

Gln10-hArg11-Ala12-Arg13-Trp14-Ile15-Gln16-Aib17-

Lys(N-epsilon-1'-alkyl beta-D-glucuronyl)18-Aib19-

NH2, wherein alkyl is dodecyl, tetradecyl, hexadecyl, or octadecyl.
```

In some embodiments, the peptide product has the structure:

```
                                            (SEQ. ID. NO. 284)
Ac5c1-Val2-Aib3-Glu4-Ile5-Gln6-Leu7-Nle8-His9-

Gln10-hArg11-Ala12-Arg13-Trp14-Ile15-Gln16-Aib17-

Lys(N-epsilon-1'-alkyl beta-D-glucuronyl)18-

Ac4c19-NH2, wherein alkyl is dodecyl, tetradecyl, hexadecyl, or octadecyl.
```

In some embodiments, the peptide product has the structure:

```
                                            (SEQ. ID. NO. 285)
Ac5c1-Val2-Aib3-Glu4-Ile5-Gln6-Leu7-Nle8-His9-

Gln10-hArg11-Ala12-Arg13-Trp14-Ile15-Glu*16-Aib17-

Lys (N-epsilon-1'-alkyl beta-D-glucuronyl)18-

Aib19-Lys*20-NH2, wherein Glu*16 and Lys*20 are linked through their sidechains by a lactam and alkyl is dodecyl, tetradecyl, hexadecyl, or octadecyl.
```

In some embodiments, the peptide product has the structure:

```
                                            (SEQ. ID. NO. 286)
Ac5c1-Val2-Aib3-Glu4-Ile5-Gln6-Leu7-Nle8-His9-

Gln10-hArg11-Glu*12-Arg13-Trp14-Ile15-Lys*16-

Aib17-Lys(N-epsilon-1'-alkyl beta-D-glucuronyl)18-

Aib19-NH2, wherein Glu*12 and Lys*16 are linked through their sidechains by a lactam and alkyl is dodecyl, tetradecyl, hexadecyl, or octadecyl.
```

In some embodiments, the peptide product has the structure:

(SEQ. ID. NO. 287)
Ac5c$_1$-Val$_2$-Aib$_3$-Glu$_4$-Ile$_5$-Gln$_6$-Leu$_7$-Nle$_8$-His$_9$-Gln$_{10}$-hArg$_{11}$-Ala$_{12}$-Arg$_{13}$-Phe$_{14}$-Ile$_{15}$-Gln$_{16}$-Aib$_{17}$-Lys(N-epsilon-1'-alkyl beta-D-glucuronyl)$_{18}$-Aib$_{19}$-NH$_2$, wherein alkyl is dodecyl, tetradecyl, hexadecyl, or octadecyl.

In some embodiments, the peptide product has the structure:

(SEQ. ID. NO. 288)
Ac5c$_1$-Val$_2$-Aib$_3$-Glu$_4$-Ile$_5$-Gln$_6$-Leu$_7$-Nle$_8$-His$_9$-Gln$_{10}$-hArg$_{11}$-Ala$_{12}$-Arg$_{13}$-Trp$_{14}$-Ile$_{15}$-Gln$_{16}$-Aib$_{17}$-Lys(N-epsilon-1'-alkyl beta-D-glucuronyl)$_{18}$-Aib$_{19}$-Aib$_{20}$-NH$_2$, wherein alkyl is dodecyl, tetradecyl, hexadecyl, or octadecyl.

In some embodiments, the peptide product has the structure:

(SEQ. ID. NO. 289)
Ac5c$_1$-Val$_2$-Aib$_3$-Glu$_4$-Ile$_5$-Gln$_6$-Leu$_7$-Nle$_8$-His$_9$-Gln$_{10}$-hArg$_{11}$-Glu*$_{12}$-Arg$_{13}$-Trp$_{14}$-Ile$_{15}$-Lys*$_{16}$-Aib$_{17}$-Lys(N-epsilon-1'-alkyl beta-D-glucuronyl)$_{18}$-Aib$_{19}$-Aib$_{20}$-NH$_2$, wherein Glu*$_{12}$ and Lys*$_{16}$ are linked through their sidechains by a lactam and alkyl is dodecyl, tetradecyl, hexadecyl, or octadecyl.

In some embodiments, the peptide product has the structure:

(SEQ. ID. NO. 207)
Ac5c$_1$-Val$_2$-Aib$_3$-Glu$_4$-Ile$_5$-Gln$_6$-Leu$_7$-Nle$_8$-His$_9$-Gln$_{10}$-hArg$_{11}$-Ala$_{12}$-Arg$_{13}$-Trp$_{14}$-Ile$_{15}$-Gln$_{16}$-Aib$_{17}$-Lys(N-epsilon-1'-dodecyl beta-D-glucuronyl)$_{18}$-Aib$_{19}$-NH$_2$.

In some embodiments, the peptide product has the structure:

(SEQ. ID. NO. 260)
Ac5c$_1$-Val$_2$-Aib$_3$-Glu$_4$-Ile$_5$-Gln$_6$-Leu$_7$-Nle$_8$-His$_9$-Gln$_{10}$-hArg$_{11}$-Ala$_{12}$-Arg$_{13}$-Trp$_{14}$-Ile$_{15}$-Gln$_{16}$-Aib$_{17}$-Lys(N-epsilon-1'-tetradecyl beta-D-glucuronyl)$_{18}$-Aib$_{19}$-NH$_2$.

In some embodiments, the peptide product has the structure:

(SEQ. ID. NO. 261)
Ac5c$_1$-VaL$_2$-Aib$_3$-Glu$_4$-Ile$_5$-Gln$_6$-Leu$_7$-Nle$_8$-His$_9$-Gln$_{10}$-hArg$_{11}$-Ala$_{12}$-Arg$_{13}$-TrP$_{14}$-Ile$_{15}$-Gln$_{16}$-Aib$_{17}$-Lys(N-epsilon-1'-hexadecyl beta-D-glucuronyL)$_{18}$-Aib$_{19}$-NH$_2$.

In some embodiments, the peptide product has the structure:

(SEQ. ID. NO. 262)
Ac5c$_1$-VaL$_2$-Aib$_3$-Glu$_4$-Ile$_5$-Gln$_6$-Leu$_7$-Nle$_8$-His$_9$-Gln$_{10}$-hArg$_{11}$-Ala$_{12}$-Arg$_{13}$-Trp$_{14}$-Ile$_{15}$-Gln$_{16}$-Aib$_{17}$-Lys(N-epsilon-1'-octadecyl beta-D-glucuronyl)$_{18}$-Aib$_{19}$-NH$_2$.

In some embodiments, the peptide product has the structure:

(SEQ. ID. NO. 275)
Ac5c$_1$-Val$_2$-Aib$_3$-Glu$_4$-Ile$_5$-Gln$_6$-Leu$_7$-Nle$_8$-His$_9$-Gln$_{10}$-hArg$_{11}$-Ala$_{12}$-Arg$_{13}$-Trp$_{14}$-Ile$_{15}$-Gln$_{16}$-Aib$_{17}$-Lys(N-epsilon-1'-dodecyl beta-D-glucuronyl)$_{18}$-Aib$_{19}$-Aib$_{20}$-NH$_2$.

In some embodiments, the peptide product has the structure:

(SEQ. ID. NO. 277)
Ac5c$_1$-Val$_2$-Aib$_3$-Glu$_4$-Ile$_5$-Gln$_6$-Leu$_7$-Nle$_8$-His$_9$-Gln$_{10}$-hArg$_{11}$-Ala$_{12}$-Arg$_{13}$-Trp$_{14}$-Ile$_{15}$-Gln$_{16}$-Aib$_{17}$-Lys(N-epsilon-1'-hexadecyl beta-D-glucuronyl)$_{18}$-Aib$_{19}$-Aib$_{20}$-NH$_2$.

In some embodiments, the peptide product is a biologically active peptide product that binds to the PTH receptor (PTHR1).

In a specific embodiment, the peptide products of Formula 2-I-A described above and herein have the following structure:

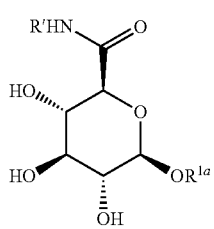

wherein $R^{1a}$ is a $C_1$-$C_{20}$ alkyl chain as described in Table 2 of FIG. 2, R' is a peptide as described in Table 2 of FIG. 2, $W^2$ of Formula I-A is —O—, and $W^1$ of Formula 2-I-A is —(C=O)NH— and is part of an amide linkage to the peptide R'. In some of such embodiments, $R^{1a}$ is a $C_6$-$C_{20}$ alkyl chain. In some of such embodiments, $R^{1a}$ is a $C_8$-$C_{20}$ alkyl chain. In some of such embodiments, $R^{1a}$ is a $C_8$-$C_{20}$ alkyl chain. In some of such embodiments, $R^{1a}$ is a $C_8$-$C_{18}$ alkyl chain. In some of such embodiments, $R^{1a}$ is a $C_8$-$C_{16}$ alkyl chain.

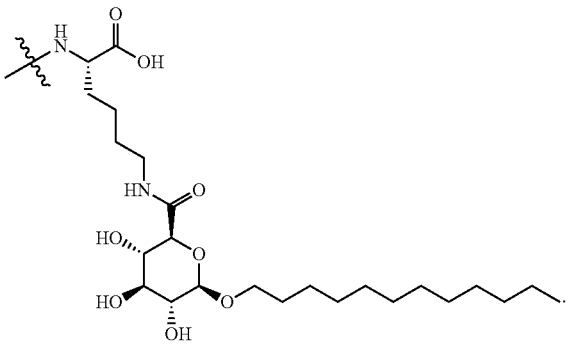

In embodiments described above, an amino moiety of an amino acid and/or a peptide R' (e.g., an amino group of an amino acid residue such as a Lysine, or a lysine within the peptide R') is used to form a covalent linkage with a compound of structure:

Also contemplated within the scope of the embodiments presented herein are peptide products of Formula 2-I-A derived from maltouronic acid-based surfactants through binding at either or both carboxylic acid functions. Thus, as one example, peptides in Table 2 of FIG. 2 comprise a lysine linker amino acid bonded to a maltouronic acid based surfactant X and having a structure:

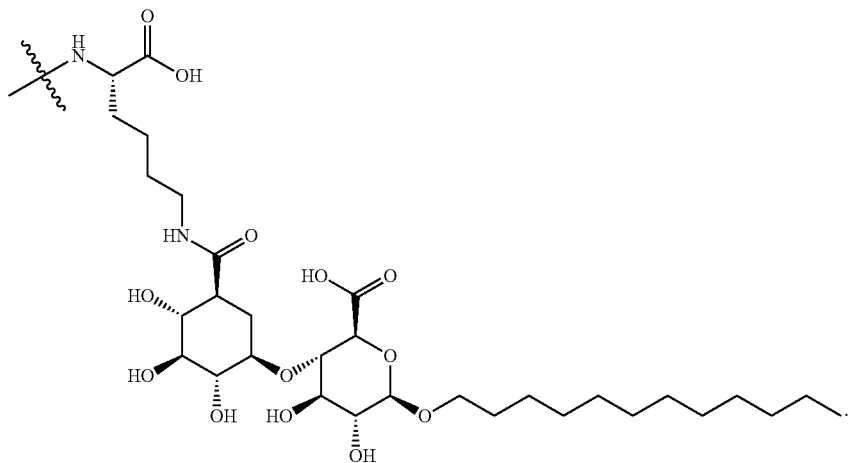 [SMILES: *N[C@@H](CCCCNC(=O)[C@H]1C[C@@H](O[C@H]2[C@H](O)[C@@H](O)[C@H](OCCCCCCCCCCCC)O[C@@H]2C(=O)O)[C@H](O)[C@@H](O)[C@@H]1O)C(=O)O]

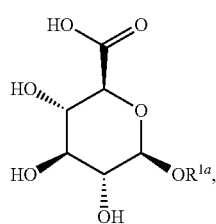

(Formula 2-A)

wherein $R^{1a}$ is a $C_1$-$C_{20}$ alkyl chain as described in Table 2 of FIG. 2.

In such cases, the amino acid having an amino moiety (e.g., a Lysine residue within the peptide R') which is used to form a covalent linkage to the compound A described above, is a linker amino acid U which is attached to a surfactant X having the structure of Formula 2-A. Accordingly, as one example, Lys(C12) of Table 2 of FIG. 2 has the following structure:

It will be understood that in one embodiment, compounds of Formula 2-I-A are prepared by attaching a lysine to a group X, followed by attachment of additional amino acid residues and/or peptides are attached to the lysine-X compound to obtain compounds of Formula 2-I-A. It will be understood that other natural or non-natural amino acids described herein are also suitable for attachment to the surfactant X and are suitable for attaching additional amino acid/peptides to obtain compounds of Formula 2-I-A. It will be understood that in another embodiment, compounds of Formula 2-I-A are prepared by attaching a full length or partial length peptide to a group X, followed by optional attachment of additional amino acid residues and/or peptides are attached to obtain compounds of Formula 2-I-A.

In a specific embodiment, provided herein are compounds selected from compounds of Table 2 in FIG. 2.

Also provided herein are pharmaceutical compositions comprising a therapeutically effective amount of a peptide product described above, or acceptable salt thereof, and at least one pharmaceutically acceptable carrier or excipient.

In some embodiments of the pharmaceutical compositions, the carrier is an aqueous-based carrier. In some embodiments of the pharmaceutical compositions, the carrier is a nonaqueous-based carrier. In some embodiments of the pharmaceutical compositions, the nonaqueous-based carrier is a hydrofluoroalkane-like solvent comprising submicron anhydrous α-lactose or other excipients.

Contemplated within the scope of embodiments presented herein is the reaction of an amino acid and/or a peptide comprising a linker amino acid U bearing a nucleophile, and a group X comprising a leaving group or a functional group that can be activated to contain a leaving group, for example a carboxylic acid, or any other reacting group, thereby allowing for covalent linkage of the amino acid and/or peptide to a surfactant X via the linker amino acid U to provide a peptide product of Formula 2-I-A.

Also contemplated within the scope of embodiments presented herein is the reaction of an amino acid and/or a peptide comprising a linker amino acid U bearing a leaving group or a functional group that can be activated to contain a leaving group, for example a carboxylic acid, or any other reacting group, and a group X comprising a nucleophilic group, thereby allowing for covalent linkage of the amino acid and/or peptide to a surfactant X via the linker amino acid U to provide a peptide product of Formula 2-I-A.

It will be understood that, in one embodiment, Compounds of Formula 2-I-A are prepared by reaction of a linker amino acid U with X, followed by addition of further residues to U to obtain the peptide product of Formula 2-I-A. It will be understood that in an alternative embodiment, Compounds of Formula 2-I-A are prepared by reaction of a suitable peptide comprising a linker amino acid U with X, followed by optional addition of further residues to U, to obtain the peptide product of Formula 2-I-A.

Provided herein are methods of treating hypoparathyroidism comprising administering to a subject in need thereof a therapeutically effective amount of a peptide product described above. In some embodiments, the hypoparathyroidism is associated with bone mass reduction.

Also provided herein are methods of stimulating bone repair or favoring the engraftment of a bone implant comprising administering to a subject in need thereof a therapeutically effective amount of a peptide product described above.

Also provided herein is a covalently modified PTH or PTHrP peptide or analog thereof, comprising a hydrophilic group as described herein; and a hydrophobic group covalently attached to the hydrophilic group. In specific embodiments, the covalently modified peptide and/or protein product comprises a hydrophilic group that is a saccharide and a hydrophobic group that is a $C_1$-$C_{20}$ alkyl chain or an aralkyl chain.

In one embodiment, provided is a method for chemically modifying a molecule by covalent linkage to a surfactant to increase or sustain the biological action of the composition or molecule, for example, receptor binding or enzymatic activity. In some embodiments, the molecule is a peptide. The method additionally can include further modification comprising covalent attachment of the molecule in the composition to a polymer such as polyethylene glycol.

In another embodiment, provided is a method of reducing or eliminating immunogenicity of a peptide and/or protein drug by covalently linking the peptide chain to at least one alkyl glycoside wherein the alkyl has from 1 to 30 carbon atoms.

Also provided is a method of treating hypoparathyroidism, osteoporosis, osteopenia, post-menopausal osteoporosis, Paget's disease, glucocorticoid induced osteoporosis, old age osteoporosis, humoral hypercalcemia, or the like comprising administering a drug composition comprising a peptide covalently linked to at least one alkyl glycoside and delivered to a vertebrate, wherein the alkyl has from 1 to 30 carbon atoms, or further in the range of 6 to 16 carbon atoms, and wherein covalent linkage of the alkyl glycoside to the peptide increases the stability, bioavailability and/or duration of action of the drug.

In some embodiments, the covalently modified peptides and/or proteins are covalently modified PTH or PTHrP, or analogs thereof, which are modified to improve their pharmaceutical and medical properties by covalent modification with alkyl glycoside surfactant moieties. These surfactant-modified analogs have increased steric hindrance that hinder proteolysis, slows uptake and slows clearance from the body.

Some studies show that approximately 50 percent of patients suffering from osteoporosis discontinue oral bisphosphonate therapy within the first year. Among patients who discontinue these treatments, many do so because of side effects including intolerance. Although truncated recombinant parathyroid hormone 1-34 (rhPTH1-34) is available commercially as a bone anabolic agent (Brixen, K. T., et al. (2004) Basic Clin Pharmacol Toxicol 94: 260-270; Dobnig, H. (2004) Expert Opin Pharmacother 5: 1153-1162) as teriparatide (Lilly), poor compliance is a major problem. More recently an antibody (denosumab, Amgen) against the ligand controlling osteoclast function has been approved, but it has significant known side effects (serious skin infections, observed cases of osteonecrosis of the jaw and significant suppression of bone remodeling), some of which may have as yet unclear long-term effects.

Bone Structure

The architecture of bone in man is maintained and elaborated by the coordinated function of osteoclasts, which cause bone resorption, and osteoblasts, which lay down new bone matrix. Bone is an important depot for storage of calcium (a critical signaling ion) in the body and a decrease in ambient extracellular Ca level causes an increase in PTH secretion in via the Ca-sensing receptors on the parathyroid cellular membrane. PTH binds to its receptor (PTHR1), present on osteoblasts cell membranes, leading to expression of the "ligand of receptor activator of nuclear factor-κB" (RANKL). RANKL binds to its receptor, RANK, on osteoclasts precursors, stimulating their differentiation and proliferation (Boyce, B. F. and Xing, L. (2007) Arthritis Res Ther 9 Suppl 1: S1). This leads to bone resorption, mobilization of calcium from the bone. PTH also acts to increase renal tubular Ca reabsorption and indirectly to enhance intestinal Ca absorption via its stimulatory action on renal 1-α cholecalciferol hydroxylase (increasing circulating calcitriol). Both actions serve to provide a longer term increase in circulating calcium ion.

The native form of human parathyroid hormone (hPTH) is an 84-amino acid peptide that plays an important role in the maintenance of Calcium homeostasis in mammals (Rosen, C. J. and Bilezikian, J. P. (2001) J Clin Endocrinol Metab 86: 957-964). A structurally-related but independent hormone, parathyroid hormone-related protein (PTHrP), plays a paracrine role, focused on bone growth in local tissue. Both hormones bind to the same receptor on osteoblasts, PTHR1, and cause activation of multiple signaling pathways, including that regulated by increased cAMP levels.

However intermittent presence of PTH(1-34) leads only to stimulation of osteoblasts, lack of RANKL expression, and increased bone density. PTH(1-34) exhibits potent anabolic effects on the skeleton when given exogenously by intermittent injection. A small group of patients received teriparatide by daily sc injections for 6-24 months (Reeve, J., et al. (1980) Br Med J 280: 1340-1344) and paired bone biopsies revealed substantial increases in iliac trabecular bone volume, with evidence of new bone formation and a suggestion that there was a dissociation between bone formation and resorption rates. Numerous studies have confirmed improvements in bone tissue after daily injections of PTH analogs (Hodsman, A. B., et al. (2005) Endocr Rev 26: 688-703; Cheng, Z., et al. (2009) J Bone Miner Res 24: 209-220). A review of the literature supports the observation that architectural improvements do occur within the skeleton after daily teriparatide injections, in contrast to the skeletal architecture observed after therapy with antiresorptive agents, which act mainly by inhibition of osteoblastic activity to reduce bone turnover, thus preserving rather than building new bone.

Continuous rather than intermittent administration of exogenous PTH(1-34) results in bone absorption. Thus treatment with infusions of PTH(1-34) for less than 6 hrs result in bone density increases but infusion for over 8 hr or longer results in bone resorption (Frolik, C. A., et al. (2003) Bone 33: 372-379). The prolonged administration of PTH (1-34) causes the expression of RANKL, activating RANK on osteoblast precursors, thus stimulating their differentiation and proliferation (Boyce, B. F. and Xing, L. (2007) Arthritis Res Ther 9 Suppl 1: S1). This observation has led to the current treatment paradigm, once daily administration of PTH(1-34) by subcutaneous injection. More recently, studies with infusion of PTH(1-34) for one day and withdrawal for one week showed important gains in bone density (Etoh, M. and Yamaguchi, A. (2010) J Bone Miner Metab, 28: 641-9)). Teriparatide has a Cmax of 10 minutes and a half life of 19 minutes (Frolik, C. A., et al. (2003) Bone 33: 372-379). A more efficacious PTH analog might be expected to give more substantive bone density increase.

During toxicology studies with PTH(1-34), and with PTH(1-84), it was observed that a substantial percentage of the rats developed osteosarcomas, beginning at around 20 months (Tashjian, A. H., Jr. and Goltzman, D. (2008) J Bone Miner Res 23: 803-811). No treatment-related sarcomas are reported in human trials with recombinant PTH(1-34), teriparatide) (Forteo®). However, treatment with current therapy is limited to <2 yrs of continuous daily subcutaneous injection.

PTH and PTHrP

In some embodiments, the methods and compositions described herein comprise the use of PTH and/or PTHrP peptides and/or proteins and/or analogs thereof. All of the biological activity of intact human PTH (hPTH1-84) resides in the N-terminal sequence; most clinical studies have used the 34-amino acid peptide hPTH(1-34), known as teriparatide. The first two amino acids are obligatory for biological activity, and it appears that the bone anabolic properties are fully maintained by the foreshortened fragment hPTH(1-31) or its cyclized lactam (Whitfield, J. F. and Morley, P. (1995) Trends Pharmacol Sci 16: 382-386). More recently studies of sequences as short as hPTH(1-11) have shown activity and can be further modified to decrease their $EC_{50}$ to the low nM range (Shimizu, M., et al. (2000) J Biol Chem 275: 21836-21843; Shimizu, N., et al. (2004) J Bone Miner Res 19: 2078-2086).

Studies of the interaction of the PTH and PTHrP with the PTH have indicated that the ligands each have two binding regions, one in the N-terminal 1-14 region and a second in the C-terminal 15-34 region. The 1-14 portion has a more locally ordered structure and interacts with the 7-transmembrane region of the receptor while the 15-34 region is alpha helical and interacts with the extracellular, N-terminal extension of the receptor. While the N-terminal region of these peptides appears to have the primary role of receptor activation through this juxtamembrane region interaction, the C-terminal helical region has important binding interactions (FIG. 2.) that give rise to higher potency of the ligand (Gardella, T. J., et al. (1994) Endocrinology 135: 1186-1194; Luck, M. D., et al. (1999) Mol Endocrinol 13: 670-680) through interaction with the extracellular region of the receptor (Dean, T., et al. (2006) J Biol Chem 281: 32485-32495; Potetinova, Z., et al. (2006) Biochemistry 45: 11113-11121). This leads to a two domain model of binding that also has been extended to other members of the family of class B GPCRs (Holtmann, M. H., et al. (1995) J Biol Chem 270: 14394-14398; Bergwitz, C., et al. (1996) J Biol Chem 271: 26469-26472; Runge, S., et al. (2003) J Biol Chem 278: 28005-28010).

Accordingly, provided herein are covalently modified peptides or peptide analogs that have a sequence that allows for binding to PTH1R. Covalent modification of ligands in PTH/PTHrP class relies on the development of N-terminal ligand sequences that interact with the juxtamembrane portion of the PTHR1 coupled to a C-terminal region that has been truncated and simplified through the use of a surfactant moiety (e.g., a 1-alkyl-glucuronic acid moiety such as the glucose-derived 1-alkylglucuronic acid). Since much of the C-terminal region interaction involves general hydrophobic interaction with the hydrophobic channel (Pioszak, A. A. and Xu, H. E. (2008) Proc Natl Acad Sci USA 105: 5034-5039; Pioszak, A. A., et al. (2009) J Biol Chem 284: 28382-28391) in the extracellular region of the receptor, the covalent modifications described herein allow for increased binding interaction through low specificity interaction.

Figure 4:
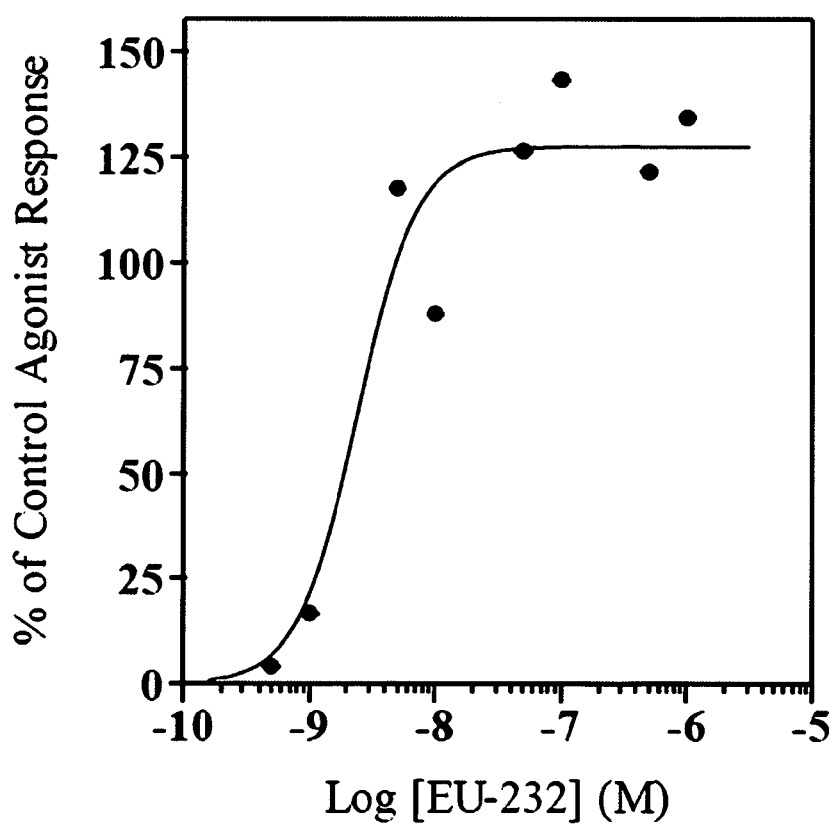
FIG. 4 shows the cAMP responses of human cells in culture (SaOS2) to stimulation by a representative peptide product described herein, EU-232. The ordinate (vertical axis) shows the response as a percentage of the maximal response shown to the internal assay standard, i.e., PTHrP. The data illustrates a super-agonistic response to EU-232.

An example of the improved cellular stimulation by a surfactant modified peptide described herein is illustrated in FIG. 4. Thus substantially greater cAMP output (125%; super-agonistic stimulation) is shown by cells stimulated with doses of EU-232 (FIG. 5) than by the internal standard, human PTHrP. Similarly, a coded sample of human PTHrP (FIG. 6; EU-285) achieves only 100% of the maximal stimulation of the internal assay standard, human PTHrP. EU-232 is modified with a 1-dodecyl β-D-glucouronic acid moiety in the C-terminal region. Importantly, shorter peptide chains or peptide chains of this size unmodified with a 1-dodecyl β-D-glucouronic acid moiety can be expected to show decreased efficacy.

Figure 7:
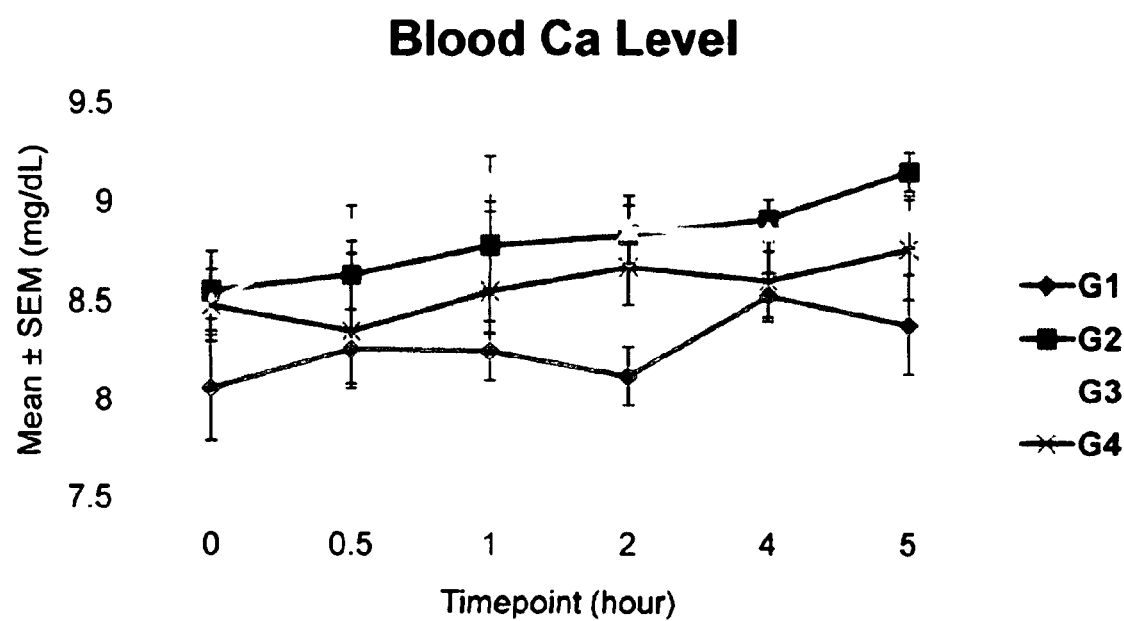
FIG. 7. Blood calcium levels in rat serum were tested at various time points after subcutaneous dosing in rats with saline (G1), 80 micrograms per kg of PTH (G2), 80 micrograms per kg of EU-232 (G3) or 320 micrograms per kg of EU-232 (G4). No groups were statistically significantly different from control (G1). Further, the maximally effective dose and time point for EU-232 (G4; at 5 hrs) shows no elevation and thus no indications of a propensity for hypercalcemia at a maximally effective dose. See Example 6.

Similarly, the in vivo response to this surfactant modified analog EU-232 shows high potency and prolonged duration of action (FIG. 7). Blood phosphate levels were tested at various time points after dosing rats with saline (G1), 80 micrograms per kg of PTH (G2), 80 micrograms per kg of EU-232 (G3) or 320 micrograms per kg of EU-232 (G4). EU-232 demonstrates prolonged duration of action in that the maximal statistically significant effect is seen at the last time point in the assay (5 hrs post dosing) and most animals show an increasing biological effect at that timepoint. In contrast PTH has a half-life of 30 minutes in the body and in a similar in vivo assay has a duration of biological effect of about 1 hr. Thus the duration of effect of the surfactant-modified compound is remarkably longer than that for the native hormone.

In some embodiments, the surfactant modified analogs described herein displays prolonged duration of action by comparison to the unmodified peptide. In some embodiments, the duration of action is longer compared to the unmodified peptide by 10 mins, 30 mins, 45 mins, 1 h, 1.5 h, 2 h, 2.5 h, 3 h, 4 h, 5 h, 5.5 h, 6 h, 6.5 h, 7 h, 7.5 h, 8 h, 8.5 h, 9 h, 9.5 h, 10 h, 11 h, 12 h, 13 h, 14 h, 15 h, 16 h, 20 h, 24 h, 36 h, or 48 h. In some embodiments, the duration of action is 1.5 times, 2 times, 2.5 times, 3 times, 3.5 times, 4 times, 4.5 times, 5 times, 6 times, 7 times, 8 times, 9 times, or 10 times longer compared to the the unmodified peptide.

As shown in FIG. 7, Blood calcium levels were tested at various time points after dosing rats with saline (G1), 80 micrograms per kg of PTH (G2), 80 micrograms per kg of EU-232 (G3) or 320 micrograms per kg of EU-232 (G4). No groups were statistically significantly different from control (G1). Importantly, the maximally effective dose and time point for EU-232 (G4; at 5 hrs) shows no elevation and thus no indications of a propensity for hypercalcemia at a maximally effective dose. Hypercalcemia is an important side effect see following administration of PTH 1-34 and of potent analogs of PTH, so this modification has demonstrated an ability to both increase desirable potency on target as well as diminished propensity for undesired side effects.

The improvements, described above and in the figures, associated with surfactant modification to yield the peptides described herein have significant implications for their use in medicine. Such molecules are suitable for use by once daily, or less frequent, administration to give enhanced biological results compared to treatment with short-acting native hormones such as PTH ($T_{1/2}$, 30 min by s.c. injection) or PTHrP. Surfactant-modified peptides such as EU-232 may be expected to show greater biological effect when administered by intranasal insufflation due to the well-known effects of surfactants on nasal bioavailability.

Accordingly, in some embodiments, surfactant-modified peptide products described herein reduce the occurrence of proteolytic degradation. In some embodiments, covalent modification of PTH and/or PTHrP and/or analogs thereof, allows for decreased cost of production of therapeutics, and provide favorable pharmaceutical properties due to the presence of the covalently attached surfactant moiety. In some embodiments, surfactant modified PTH and/or PTHrP described herein prolong the PK and duration of action (PD) behavior of the resulting ligands compared to other known peptide ligands (such as those of Dean, et al. (Dean, T., et al. (2006) J Biol Chem 281: 32485-32495)) that lack such covalent modifications. Also contemplated within the scope of embodiments presented herein is long term and safe administration of surfactant modified PTH and/or PTHrP and/or analogs thereof.

In some instances, the N-terminal binding region ends at about residue 14 and the helical region encompasses residue 16 onward. Thus a ligand optimized in the 1-14 region with a 1-alkylglucuronic acid modification in the 15 onward region will have high specific binding (N-terminus) with high potency (1-alkyl modification). Use of an α-helical stabilizing substitution (Kaul, R. and Balaram, P. (1999) Bioorg Med Chem 7: 105-117) in the C-terminal region leads to higher helical content and higher potency. Commonly used α-helical stabilizers are Ala and the class of 1,1-dialkyl amino acids such as Aib, Ac4c, Ac5c and the like (see definitions below). Minimization of the PTH structure led to shortened analogs (Shimizu, M., et al. (2000) J Biol Chem 275: 21836-21843) wherein constrained α-helical stabilizers led to important potency increases. For example, substitution of Aib into position 1 and 3 of PTH1-14 and PTH1-11 analogs led to increased potency (Shimizu, N., et al. (2001) J Biol Chem 276: 49003-49012). Incorporation of more hindered α-helical stabilizers in position 1 lead to further potency increases (Shimizu, N., et al. (2004) J Bone Miner Res 19: 2078-2086). Substitution of Aib into various positions of PTH1-34 analogs also led to improvements in potency, particularly substitutions at positions 12 and 13 (Peggion, E., et al. (2003) Biopolymers 68: 437-457). However it was shown that Aib in positions 1 and 3 of the simple PTH1-11 sequence was not acceptable (Barazza, A., et al. (2005) J Pept Res 65: 23-35). Thus, in some embodiments, the α-helical content of PTH and/or PTHrP is a determinant of peptide product stability (Marx, U. C., et al. (1995) J Biol Chem 270: 15194-15202; Schievano, E., et al. (2000) Biopolymers 54: 429-447).

In some embodiments, the use of a long side chain, such as in the Nε-(1'-dodecyl beta-D-glucuronyl)-lysine in covalent peptide modifications described herein, destabilizes an α-helix. Accordingly, also contemplated within the scope of embodiments presented herein are modifications that comprise α-helical stabilizers. Thus in some embodiments, surfactant modified peptide products described herein comprise a helix stabilizer (e.g., in the position just N-Terminal and/or just C-terminal of the surfactant substitution). In some embodiments, an α-helix stabilizer is located at position 12 in the PTH and/or PTHrP chain. By way of example only, the table below describes EU-212 to EU-282 certain surfactant modified peptide products (EU-212 to EU-282) that comprise an α-helix stabilizer.

In one aspect, the peptides that are covalently modified and are suitable for methods described herein are truncated analogs of PTHrP and/or the related hormone PTH, including and not limited to:

hPTH(1-34):
(SEQ. ID. NO. 290)
$Ser_1$-$Val_2$-$Ser_3$-$Glu_4$-$Ile_5$-$Gln_6$-$Leu_7$-$Met_8$-

$His_9$-$Asn_{10}$-$Leu_{11}$-$Gly_{12}$-$Lys_{13}$-$His_{14}$-$Leu_{15}$-

$Asn_{16}$-$Ser_{17}$-$Met_{18}$-$Glu_{19}$-$Arg_{20}$-$Val_{21}$-$Glu_{22}$-

$Trp_{23}$-$Leu_{24}$-$Arg_{25}$-$Lys_{26}$-$Lys_{27}$-$Leu_{28}$-$Gln_{29}$-

$Asp_{30}$-$Val_{31}$-$His_{32}$-$Asn_{33}$-$Phe_{34}$-OH;
or hPTHrP(1-34):
(SEQ. ID. NO. 291)
$Ala_1$-$Val_2$-$Ser_3$-$Glu_4$-$His_5$-$Gln_6$-$Leu_7$-

$Leu_8$-$His_9$-$Asp_{10}$-$Lys_{11}$-$Gly_{12}$-$Lys_{13}$-$Ser_{14}$-

$Leu_{15}$-$Gln_{16}$-$Asp_{17}$-$Leu_{18}$-$Arg_{19}$-$Arg_{20}$-$Arg_{21}$-$Phe_{22}$-

$Phe_{23}$-$Leu_{24}$-$His_{25}$-$His_{26}$-$Leu_{27}$-$Ile_{28}$-$Ala_{29}$-

$Glu_{30}$-$Ile_{31}$-$His_{32}$-$Thr_{33}$-$Ala_{34}$-OH

In some embodiments, a peptide product described herein has the structure of Formula 2-V:

(SEQ. ID. NO. 172)
$aa_1$-$aa_2$-$aa_3$-$aa_4$-$aa_5$ $aa_6$-$aa_7$-$aa_8$-$aa_9$-$aa_{10}$-$aa_{11}$-

$aa_{12}$-$aa_{13}$-$aa_{14}$-$aa_{15}$-$aa_{16}$-$aa_{17}$-$aa_{18}$-

$aa_{19}$-$aa_{20}$-$aa_{21}$-$aa_{22}$-$aa_{23}$-$aa_{24}$-$aa_{25}$-$aa_{26}$-$aa_{27}$-

$aa_{28}$-$aa_{29}$-$aa_{30}$-$aa_{31}$-$aa_{32}$-$aa_{33}$-$aa_{34}$-$aa_{35}$-

$aa_{36}$-Z FORMULA 2-V wherein:
Z is OH, or —NH—R³, wherein R³ is H or $C_1$-$C_{12}$ alkyl; or a PEG chain of less than 10 Da.
$aa_1$ is Ala, Ser, Val, Pro, Aib, Ac5c, or Deg;
$aa_2$ is Val;
$aa_3$ is Ser, Ala, Aib, Ac4c, or Deg;
$aa_4$ is Glu;
$aa_5$ is His, or Ile;
$aa_6$ is Gln, or Cit;
$aa_7$ is Leu, or Phe;
$aa_8$ is Leu, Met, or Nle;
$aa_9$ is His;
$aa_{10}$ is Asp, Asn, Gln, Glu, Cit, Ala, or Aib;
$aa_{11}$ is Lys, Leu, Ile, Arg, or hArg;
$aa_{12}$ is Gly, Ala, Glu, Lys, Aib, or Ac5c;
$aa_{13}$ is Lys, or Arg;
$aa_{14}$ is Ser, His, Trp, Phe, Leu, Arg, Lys, Glu, Nal(2), or cyclized to position $aa_{18}$;
$aa_{15}$ is Ile, Leu, Aib;
$aa_{16}$ is Gln, Asn, Glu, Lys, Ser, Cit, Aib, Ac5c, U(X);
$aa_{17}$ is Asp, Ser, Aib, Ac4c, Ac5c, U(X), Z;
$aa_{18}$ is absent, Leu, Gln, Cit, Aib, Ac5c, Lys, Glu, or U(X), or cyclized to position $aa_{14}$;
$aa_{19}$ is absent, Arg, Glu, Aib, Ac4c, Ac5c, or U(X);
$aa_{20}$ is absent, Arg, Glu, Lys, Aib, Ac4c, Ac5c, or U(X);
$aa_{21}$ is absent, Arg, Val, Aib, Ac5c, Deg, or U(X);
$aa_{22}$ is absent, Phe, Glu, Aib, Ac5c, Lys, U(X), or cyclized to position $aa_{18}$ or $aa_{26}$;
$aa_{23}$ is absent, or Leu, Phe, Trp, or U(X);
$aa_{24}$ is absent, His, Arg, Leu, Aib, Ac5c or U(X);
$aa_{25}$ is absent, His, Lys, Arg, or U(X);
$aa_{26}$ is absent, His, Lys, Arg, Aib, Ac5c or cyclized to position $aa_{22}$;
$aa_{27}$ is absent, Leu, or Lys;
$aa_{28}$ is absent, Ile, or Leu;
$aa_{29}$ is absent, Ala, Gln, Cit, or Aib;
$aa_{30}$ is absent, Glu, Asp, or Aib;
$aa_{31}$ is absent, Ile, Val, Aib, Ac5C, or U(X);
$aa_{32}$ is absent, His, Aib, Ac5C, or U(X);
$aa_{33}$ is absent, Thr, Asn, Aib, Ac5C, or U(X);
$aa_{34}$ is absent, Ala, Phe, Aib, Ac5C, or U(X);
$aa_{35}$ is absent, Aib, Ac5C, or U(X);
$aa_{36}$ is absent, Aib, Ac5C, or U(X);
U is a linking amino acid; and
X is a surfactant-linked to the side chain of U;
wherein any two of $aa_1$-$aa_{36}$ are optionally cyclized through their side chains to form a lactam linkage; and provided that one, or least one of $aa_1$-$aa_{36}$ is U.

In some embodiments, a peptide product described herein comprises $aa_1$-$aa_{20}$ of Formula V as described above (SEQ. ID. NO. 292). In some embodiments, a peptide product described herein comprises $aa_1$-$aa_{19}$ of Formula V as described above (SEQ. ID. NO. 293).

In specific embodiments, the linking amino acid U, is a diamino acid like Lys or Orn, X is a modified surfactant from the 1-alkyl glycoside class linked to U, and Z is OH, or —NH—R³, wherein R³ is H or $C_1$-$C_{12}$; or a PEG chain of less than 10 Da.

In some embodiments, a peptide product described herein has the structure of Formula 2-VI:

(SEQ. ID. NO. 173)
$aa_1$-$Val_2$-$aa_3$-$Glu_4$-$aa_5$ $aa_6$-$aa_7$-$aa_8$-$His_9$-$aa_{10}$-$aa_{11}$-

$aa_{12}$-$aa_{13}$-$aa_{14}$-$aa_{15}$-$aa_{16}$-$aa_{17}$-$aa_{18}$-$aa_{19}$-$aa_{20}$-$aa_{21}$-

$aa_{22}$-$aa_{23}$-$aa_{24}$-$aa_{25}$-$aa_{26}$-Z Formula 2-VI wherein:
Z is OH, or —NH—R³, wherein R³ is H, $C_1$-$C_{12}$ alkyl or a PEG chain of less than 10 Da;
$aa_1$ is Aib, Ac5c, Deg;
$aa_3$ is Aib, Ac4c, Deg;
$aa_5$ is His, Ile;
$aa_6$ is Gln, Cit;
$aa_7$ is Leu, Phe;
$aa_8$ is Leu, Nle;
$aa_{10}$ is Asp, Asn, Gln, Glu, Cit, Ala, Aib;
$aa_{11}$ is Arg, hArg;
$aa_{12}$ is Gly, Ala, Glu, Lys, Aib, Ac5c;
$aa_{13}$ is Lys, Arg;
$aa_{14}$ is Ser, His, Trp, Phe, Leu, Arg, Lys, Nal(2);
$aa_{15}$ is Ile, Leu, Aib;
$aa_{16}$ is Gln, Asn, Glu, Lys, Ser, Cit, Aib, U(X);
$aa_{17}$ is Asp, Ser, Aib, Ac4c, Ac5c, U(X);
$aa_{18}$ is absent or Leu, Gln, Cit, Aib, Ac5c, Lys, Glu, U(X);
$aa_{19}$ is absent or Arg, Glu, Aib, Ac4c, Ac5c, U(X);
$aa_{20}$ is absent or Arg, Glu, Lys, Aib, Ac4c, Ac5c, U(X);
$aa_{21}$ is absent or Arg, Val, Aib, Ac5C, Deg U(X);
$aa_{22}$ is absent or Phe, Glu, Lys or U(X);
$aa_{23}$ is absent or Leu, Phe, Trp or U(X);
$aa_{24}$ is absent or Leu, His, Arg, or U(X);
$aa_{25}$ is absent or His, Lys, or U(X) and
$aa_{26}$ is absent or Aib, Ac5c;
U is a linking amino acid;
X is a modified surfactant from the 1-alkyl glycoside class linked to U, wherein the 1-alkyl group is substituted or unsubstituted $C_1$-$C_{20}$ alkyl or substituted or unsubstituted $C_1$-$C_{20}$ aralkyl;
provided that one, or least one of $aa_1$-$aa_{26}$ is U.

In some embodiments, a peptide product described herein has the structure of Formula 2-VII (SEQ. ID. NO. 174)
$aa_1$-$Val_2$-$Aib_3$-$Glu_4$-$Ile_5$-$Gln_6$-$Leu_7$-$Nle_8$-$His_9$-

$Gln_{10}$-$hArg_{11}$-$aa_{12}$-$Arg_{13}$-$aa_{14}$-$Ile_{15}$-$aa_{16}$-$aa_{17}$-

$aa_{18}$-$aa_{19}$-$aa_{20}$-$aa_{21}$-$aa_{22}$-$aa_{23}$-$aa_{24}$-$aa_{25}$-$aa_{26}$-Z

Formula 2-VII wherein:
Z is OH or —NH₂;
$aa_1$ is Aib, Ac5c;
$aa_{12}$ is Ala, Glu, Lys, Aib, Ac5c;
$aa_{14}$ is Trp, Phe, Nal(2);
$aa_{16}$ is Gln, Asn, Glu, Lys, Cit, U(X);
$aa_{17}$ is Asp, Ser, Aib, Ac4c, Ac5c, U(X);
$aa_{18}$ is absent or Leu, Gln, Aib, U(X);
$aa_{19}$ is absent or Arg, Glu, Aib, Ac4c, Ac5c;
$aa_{20}$ is absent or Arg, Glu, Lys, Aib, Ac4c, Ac5c;
$aa_{21}$ is absent or Arg, Val, Aib, Ac5C, Deg;
$aa_{22}$ is absent or Phe, Glu, Lys or U(X);
$aa_{23}$ is absent or Leu, Phe, Trp or U(X);
$aa_{24}$ is absent or His, Arg, or U;
$aa_{25}$ is absent or His, Lys, or U and
$aa_{26}$ is absent or Aib, Ac5c;
U is a linking amino acid; and
X is a modified surfactant from the 1-alkyl glycoside class linked to U, wherein the 1-alkyl group is substituted or unsubstituted $C_1$-$C_{20}$ alkyl or substituted or unsubstituted $C_1$-$C_{20}$ aralkyl;

provided that one, or least one of $aa_1$-$aa_{26}$ is U.

In some embodiments, the peptide product has the structure of Formula 2-III:

(SEQ. ID. NO. 171)
$aa_1$-$Val_2$-$Aib_3$-$Glu_4$-$Ile_5$-$Gln_6$-$Leu_7$-$Nle_8$-$His_9$-

$Gln_{10}$-$hArg_{11}$-$aa_{12}$-$Arg_{13}$-$aa_{14}$-$Ile_{15}$-$aa_{16}$-$aa_{17}$-$aa_{18}$-

$aa_{19}$-$aa_{20}$-$aa_{21}$-$aa_{22}$-$aa_{23}$-$aa_{24}$-$aa_{25}$-$aa_{26}$-Z Formula 2-III wherein:
Z is OH or —$NH_2$;
$aa_1$ is Aib, or Ac5c;
$aa_{12}$ is Ala, Aib, Glu, Lys, or Ac5c;
$aa_{14}$ is Trp, Phe, Lys, Glu or Nal(2);
$aa_{16}$ is Gln, Asn, Glu, Lys, Cit, or U(X);
$aa_{17}$ is Asp, Ser, Aib, Ac4c, Ac5c, or U(X);
$aa_{18}$ is absent or Leu, Gln, Aib, Lys, Glu or U(X);
$aa_{19}$ is absent or Arg, Glu, Aib, Ac4c, or Ac5c;
$aa_{20}$ is absent or Arg, Glu, Lys, Aib, Ac4c, Ac5c;
$aa_{21}$ is absent or Arg, Val, Aib, Ac5C, or Deg;
$aa_{22}$ is absent or Phe, Glu, Lys or U(X);
$aa_{23}$ is absent or Leu, Phe, Trp or U(X);
$aa_{24}$ is absent or His, Arg, or U(X);
$aa_{25}$ is absent or His, Lys, or U(X); and
$aa_{26}$ is absent or Aib, Ac5c;

wherein any two of $aa_1$-$aa_{26}$ are optionally cyclized through their side chains to form a lactam linkage; and provided that one, or at least one of $aa_{16}$, $aa_{17}$, $aa_{18}$, $aa_{22}$, $aa_{23}$, $aa_{24}$ or $aa_{25}$ is the linker amino acid U covalently attached to X.

In a specific embodiment of Formula 2-III above, X has the structure:

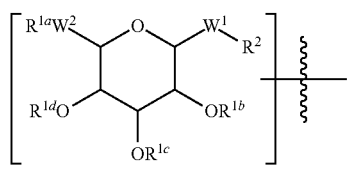

Formula 2-I wherein:
$R^{1a}$ is a substituted or unsubstituted $C_1$-$C_{30}$ alkyl group;
$R^{1b}$, $R^{1c}$, and $R^{1d}$ are H;
$W^1$ is —(C=O)—NH—;
$W^2$ is —O—; and
$R^2$ is a bond.

In some of the embodiments described above, $R^{1a}$ is a $C_1$-$C_{20}$ alkyl group, a $C_1$-$C_{18}$ alkyl group, a $C_1$-$C_{16}$ alkyl group, or $C_1$-$C_{12}$ alkyl group. In some embodiments of Formula 2-III, U is any linker amino acid described herein.

Contemplated within the scope of embodiments presented herein are peptide products of Formula 2-I-A, Formula 2-III, Formula 2-V, Formula 2-VI or Formula 2-VII, wherein the peptide product comprises one, or, more than one surfactant groups (e.g., group X having the structure of Formula I). In one embodiment, a peptide product of Formula 2-I-A, Formula 2-III, Formula 2-V, Formula 2-VI or Formula 2-VII comprises one surfactant group. In another embodiment, a peptide product of Formula 2-I-A, Formula 2-III, Formula 2-V, Formula 2-VI or Formula 2-VII comprises two surfactant groups. In yet another embodiment, a peptide product of Formula 2-I-A, Formula 2-III, Formula 2-V, Formula 2-VI or Formula 2-VII comprises three surfactant groups.

Table 2 in FIG. 2 illustrates certain examples of peptides that are suitable for covalent linkage with surfactants as described herein.

Recognized herein is the importance of certain portions of SEQ. ID. NO. 170 for the treatment of conditions associated with bone loss and/or hyperparathyroidism including, and not limited to, osteoporosis, osteopenia, post-menopausal osteoporosis, Paget's disease, glucocorticoid-induced osteoporosis, inflammatory bone loss, fixation of implants, osteonecrosis of the jaw, stem cell proliferation, old age osteoporosis, humoral hypercalcemia, or the like.

Accordingly, provided herein is a method of treating conditions associated with bone loss (e.g., osteoporosis) and/or hyperparathyroidism in an individual in need thereof comprising administration of a therapeutically effective amount of a PTH analog comprising amino acid residues $aa_1$-$aa_{17}$ of SEQ. ID. NO. 170 to the individual in need thereof.

In a further embodiment, provided herein is a method of treating conditions associated with bone loss (e.g., osteoporosis) and/or hyperparathyroidism in an individual in need thereof comprising administration of a therapeutically effective amount of a PTH analog comprising amino acid residues $aa_1$-$aa_{18}$ of SEQ. ID. NO. 170 to the individual in need thereof.

In another embodiment, provided herein is a method of treating conditions associated with bone loss (e.g., osteoporosis) and/or hyperparathyroidism in an individual in need thereof comprising administration of a therapeutically effective amount of a PTH analog comprising amino acid residues $aa_1$-$aa_{19}$ of SEQ. ID. NO. 170 to the individual in need thereof.

In another embodiment, provided herein is a method of treating conditions associated with bone loss (e.g., osteoporosis) and/or hyperparathyroidism in an individual in need thereof comprising administration of a therapeutically effective amount of a PTH analog comprising amino acid residues $aa_1$-$aa_{20}$ of SEQ. ID. NO. 170 to the individual in need thereof.

In an additional embodiment, the administration of the said PTH analog described above causes increase in bone density.

Recognized herein is the importance of certain portions of SEQ. ID. NOs. 171, 173, 174, 207, 261 or 262 for the treatment of conditions associated with bone loss and/or hyperparathyroidism. including, and not limited to, osteoporosis, osteopenia, post-menopausal osteoporosis, Paget's disease, glucocorticoid-induced osteoporosis, inflammatory bone loss, fixation of implants, osteonecrosis of the jaw, stem cell proliferation, old age osteoporosis, humoral hypercalcemia, or the like.

Accordingly, provided herein is a method of treating conditions associated with bone loss and/or hyperparathyroidism in an individual in need thereof comprising administration of a therapeutically effective amount of a PTH analog comprising amino acid residues $aa_1$-$aa_{17}$ of SEQ. ID. NOs. 171, 173, 174, 290, 207, 261, 262 or 291 to the individual in need thereof.

In a further embodiment, provided herein is a method of treating conditions associated with bone loss (e.g., osteoporosis) and/or hyperparathyroidism in an individual in need thereof comprising administration of a therapeutically effective amount of a PTH analog comprising amino acid residues $aa_1$-$aa_{18}$ of SEQ. ID. NOs, 171, 173, 174, 290, 207, 261, 262 or 291 to the individual in need thereof.

In another embodiment, provided herein is a method of treating conditions associated with bone loss (e.g., osteoporosis) and/or hyperparathyroidism in an individual in need thereof comprising administration of a therapeutically effective amount of a PTH analog comprising amino acid residues $aa_1$-$aa_{19}$ of SEQ. ID. NOs. 171, 173, 174, 290, 207, 261, 262 or 291 to the individual in need thereof.

In another embodiment, provided herein is a method of treating conditions associated with bone loss (e.g., osteoporosis) and/or hyperparathyroidism in an individual in need thereof comprising administration of a therapeutically effective amount of a PTH analog comprising amino acid residues $aa_1$-$aa_{20}$ of SEQ. ID. NOs. 171, 173, 174, 290, 275, 281 or 291 to the individual in need thereof.

In an additional embodiment, the administration of the said PTH analog described above causes increase in bone density.

In any of the embodiments described above, the said PTH analog is modified with a surfactant X of Formula 2-I:

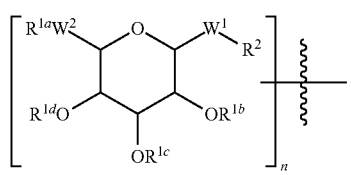

Formula 2-I wherein:
$R^{1a}$ is independently, at each occurrence, a bond, H, a substituted or unsubstituted $C_1$-$C_{30}$ alkyl group, a substituted or unsubstituted alkoxyaryl group, a substituted or unsubstituted aralkyl group, or a steroid nucleus containing moiety;
$R^{1b}$, $R^{1c}$, and $R^{1d}$ are each, independently at each occurrence, a bond, H, a substituted or unsubstituted $C_1$-$C_{30}$ alkyl group, a substituted or unsubstituted alkoxyaryl group, or a substituted or unsubstituted aralkyl group;
$W^1$ is independently, at each occurrence, —$CH_2$—, —$CH_2$—O—, —(C=O)—, —(C=O)—O—, —(C=O)—NH—, —(C=S)—, —(C=S)—NH—, or —$CH_2$—S—;
$W^2$ is —O—, —$CH_2$— or —S—;
$R^2$ is independently, at each occurrence, a bond to U, H, a substituted or unsubstituted $C_1$-$C_{30}$ alkyl group, a substituted or unsubstituted alkoxyaryl group, or a substituted or unsubstituted aralkyl group, —$NH_2$, —SH, $C_2$-$C_4$-alkene, $C_2$-$C_4$-alkyne, —NH(C=O)—$CH_2$—Br, —$(CH_2)_m$-maleimide, or —$N_3$;
n is 1, 2 or 3; and
m is 1-10.

In a specific embodiment, the said PTH analog is modified with a surfactant, X having the structure:

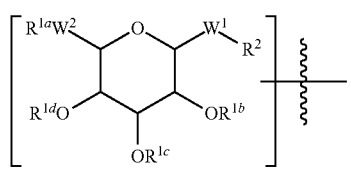

Formula 2-I wherein:
$R^{1a}$ is a substituted or unsubstituted $C_1$-$C_{30}$ alkyl group;
$R^{1b}$, $R^{1c}$, and $R^{1d}$ are H;

$W^1$ is —(C=O)—NH—;
$W^2$ is —O—; and
$R^2$ is a bond.

In some of the embodiments described above, $R^{1a}$ is a $C_1$-$C_{20}$ alkyl group, a $C_8$-$C_{20}$ alkyl group, $C_{12}$-$C_{18}$ alkyl group or $C_{14}$-$C_{18}$ alkyl group.

Modifications at the amino or carboxyl terminus may optionally be introduced into the peptides (e.g., PTH or PTHrP) (Nestor, J. J., Jr. (2009) Current Medicinal Chemistry 16: 4399-4418). For example, the peptides can be truncated or acylated on the N-terminus to yield peptides analogs exhibiting low efficacy, partial agonist and antagonist activity, as has been seen for some peptides (Gourlet, P., et al. (1998) Eur J Pharmacol 354: 105-111, Gozes, I. and Furman, S. (2003) Curr Pharm Des 9: 483-494), the contents of which is incorporated herein by reference). For example, deletion of the first 6 residues of bPTH yields antagonistic analogs (Mahaffey, J. E., et al. (1979) J Biol Chem 254: 6496-6498; Goldman, M. E., et al. (1988) Endocrinology 123: 2597-2599) and a similar operation on peptides described herein generates potent antagonistic analogs. Other modifications to the N-terminus of peptides, such as deletions or incorporation of D-amino acids such as D-Phe also can give potent and long acting agonists or antagonists when substituted with the modifications described herein such as long chain alkyl glycosides. Such agonists and antagonists also have commercial utility and are within the scope of contemplated embodiments described herein.

Also contemplated within the scope of embodiments presented herein is N-terminal truncation of PTH (e.g. 7-34 residue analogs) or PTHrP thereby providing inverse agonists (Gardella, T. J., et al. (1996) Endocrinology 137: 3936-3941) or antagonists. In some embodiments, inverse agonists and/or antagonists of PTH and/or PTHrP are useful for treatment of "humoral hypercalcemia" associated with a wide range of tumors.

Also contemplated within the scope of embodiments described herein are surfactants covalently attached to peptide analogs, wherein the native peptide is modified by acetylation, acylation, PEGylation, ADP-ribosylation, amidation, covalent attachment of a lipid or lipid derivative, covalent attachment of phosphotidylinositol, cross-linking, cyclization, disulfide bond formation, demethylation, formation of covalent cross-link formation of cysteine, formation of pyroglutamate, formylation, gamma-carboxylation, glycosylation, GPI anchor formation, hydroxylation, iodination, methylation, myristoylation, oxidation, proteolytic processing, phosphorylation, prenylation, racemization, glycosylation, lipid attachment, sulfation, gamma-carboxylation of glutamic acid residues, hydroxylation and ADP-ribosylation, selenoylation, sulfation, transfer-RNA mediated addition of amino acids to proteins, such as arginylation, and ubiquitination. See, for instance, (Nestor, J. J., Jr. (2007) Comprehensive Medicinal Chemistry II 2: 573-601, Nestor, J. J., Jr. (2009) Current Medicinal Chemistry 16: 4399-4418, Creighton, T. E. (1993, Wold, F. (1983) Posttranslational Covalent Modification of Proteins 1-12, Seifter, S. and Englard, S. (1990) Methods Enzymol 182: 626-646, Rattan, S. I., et al. (1992) Ann N Y Acad Sci 663: 48-62).

Also contemplated within the scope of embodiments described herein are peptides that are branched or cyclic, with or without branching. Cyclic, branched and branched circular peptides result from post-translational natural processes and are also made by suitable synthetic methods. In some embodiments, any peptide product described herein comprises a peptide analog described above that is then covalently attached to an alkyl-glycoside surfactant moiety.

Also contemplated within the scope of embodiments presented herein are peptide chains that are substituted in a suitable position by the modification of the analogs claimed herein, e.g., by acylation on a linker amino acid, at for example the ε-position of Lys, with fatty acids such as octanoic, decanoic, dodecanoic, tetradecanoic, hexadecanoic, octadecanoic, 3-phenylpropanoic acids and the like, or with saturated or unsaturated alkyl chains (Zhang, L. and Bulaj, G. (2012) Curr Med Chem 19: 1602-1618). Non-limiting, illustrative examples of such analogs are:

(SEQ. ID. NO. 294)
$Ac5c_1$-$Val_2$-$Aib_3$-$Glu_4$-$Ile_5$-$Gln_6$-$Leu_7$-

$Nle_8$-$His_9$-$Gln_{10}$-$hArg_{11}$-$Ala_{12}$-$Arg_{13}$-$Trp_{14}$-

$Ile_{15}$-$Gln_{16}$-$Aib_{17}$-

$Lys(N$-$epsilon$-$dodecanoyl)_{18}$-$Aib_{19}$-$NH_2$, (SEQ. ID. NO. 295)
$Ac5c_1$-$Val_2$-$Aib_3$-$Glu_4$-$Ile_5$-$Gln_6$-$Leu_7$-

$Nle_8$-$His_9$-$Gln_{10}$-$hArg_{11}$-$Ala_{12}$-$Arg_{13}$-$Trp_{14}$-

$Ile_{15}$-$Gln_{16}$-$Aib_{17}$-

$Lys(N$-$epsilon$-$dodecanoyl)_{18}$-$NH_2$, (SEQ. ID. NO. 296)
$Ac5c_1$-$Val_2$-$Aib_3$-$Glu_4$-$Ile_5$-$Gln_6$-$Leu_7$-

$Nle_8$-$His_9$-$Gln_{10}$-$hArg_{11}$-$Ala_{12}$-$Arg_{13}$-$Trp_{14}$-

$Ile_{15}$-$Gln_{16}$-$Aib_{17}$-

$Lys(N$-$epsilon$-$palmitoyl)_{18}$-$Aib_{19}$-$NH_2$, (SEQ. ID. NO. 297)
$Ac5c_1$-$Val_2$-$Aib_3$-$Glu_4$-$Ile_5$-$Gln_6$-$Leu_7$-

$Nle_8$-$His_9$-$Gln_{10}$-$hArg_{11}$-$Ala_{12}$-$Arg_{13}$-$Phe_{14}$-

$Ile_{15}$-$Gln_{16}$-$Aib_{17}$-

$Lys(N$-$epsilon$-$dodecanoyl)_{18}$-$Aib_{19}$-$NH_2$, (SEQ. ID. NO. 298)
$Ac5c_1$-$Val_2$-$Aib_3$-$Glu_4$-$Ile_5$-$Gln_6$-$Leu_7$-

$Nle_8$-$His_9$-$Gln_{10}$-$hArg_{11}$-$Ala_{12}$-$Arg_{13}$-$Trp_{14}$-

$Ile_{15}$-$Gln_{16}$-$Aib_{17}$-

$Lys(N$-$epsilon$-$tetradecanoyl)_{18}$-$Aib_{19}$-$NH_2$, (SEQ. ID. NO. 299)
$Ac5c_1$-$Val_2$-$Aib_3$-$Glu_4$-$Ile_5$-$Gln_6$-$Leu_7$-

$Nle_8$-$His_9$-$Gln_{10}$-$hArg_{11}$-$Ala_{12}$-$Arg_{13}$-$Trp_{14}$-

$Ile_{15}$-$Gln_{16}$-$Aib_{17}$-

$Lys(N$-$epsilon$-$tetradecanoyl)_{18}$-$Aib_{19}$-$Aib_{20}$-$NH_2$, (SEQ. ID. NO. 300)
$Ac5c_1$-$Val_2$-$Aib_3$-$Glu_4$-$Ile_5$-$Gln_6$-$Leu_7$-

$Nle_8$-$His_9$-$Gln_{10}$-$hArg_{11}$-$Ala_{12}$-$Arg_{13}$-$Trp_{14}$-

$Ile_{15}$-$Gln_{16}$-$Aib_{17}$-

$Lys(N$-$epsilon$-$(Nalpha$-$dodecanoyl$-$L$-$glutamyl))_{18}$-

$Aib_{19}$-$NH_2$,
and the like.

In other embodiments, a peptide chain is substituted in a suitable position by reaction on a linker amino acid, for example the sulfhydryl of Cys, with a spacer and a hydrophobic moiety such as a steroid nucleus, for example a cholesterol moiety. In some of such embodiments, the modified peptide further comprises one or more PEG chains. Non-limiting examples of such molecules are:

(SEQ. ID. NO. 301)
$Ac5c_1$-$Val_2$-$Aib_3$-$Glu_4$-$Ile_5$-$Gln_6$-

$Leu_7$-$Nle_8$-$His_9$-$Gln_{10}$-$hArg_{11}$-$Ala_{12}$-$Arg_{13}$-$Trp_{14}$-

$Ile_{15}$-$Gln_{16}$-$Aib_{17}$-

$Cys(S$-$(3$-$(PEG4$-$aminoethylacetamide$-

$Cholesterol)))_{18}$-$Aib_{19}$-$NH_2$, (SEQ. ID. NO. 302)
$Ac5c_1$-$Val_2$-$Aib_3$-$Glu_4$-$Ile_5$-$Gln_6$-

$Leu_7$-$Nle_8$-$His_9$-$Gln_{10}$-$hArg_{11}$-$Ala_{12}$-$Arg_{13}$-$Trp_{14}$-

$Ile_{15}$-$Gln_{16}$-$Aib_{17}$-

$Cys(S$-$(3$-$(PEG4$-$aminoethylacetamide$-

$Cholesterol)))_{18}$-$NH_2$,
and the like.

In some embodiments, the modified peptides described herein displays improved protection from proteolysis when compared to the unmodified peptide. In some embodiments, the proteolysis of the modified peptides described herein is reduced by 10-90%, 10-20%, 10-50%, 20-80%, 20-40%, 20-30%, 30-60%, 30-50%, 30-40%, 10-30%, 15-30%, 15-45%, 50-75%, 60-75%, 70-90%, or 80-100% when compared with the unmodified peptide. In some embodiments, the proteolysis of the modified peptides described herein is reduced by 5%, 10%, 15%, 20%, 25%, 30%, 35%, 40%, 45%, 50%, 55%, 60%, 65%, 70%, 75%, 80%, 85%, 90%, 95%, 98%, 100%, greater than 5%, greater than 10%, greater than 15%, greater than 20%, greater than 25%, greater than 30%, greater than 35%, greater than 40%, greater than 45%, greater than 50%, greater than 55%, greater than 60%, greater than 65%, greater than 70%, greater than 75%, greater than 80%, greater than 85%, greater than 90%, greater than 95%, greater than 98%, at least 2%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 98% when compared with the unmodified peptide.

In some embodiments, the modified peptides described herein display arrestin-biased agonism. In other embodiments, the modified peptides described herein display arrestin-biased antagonism.

In some embodiments, any of the modified peptides described herein displays improved receptor binding potency and/or cellular activation potency compared to the unmodified peptide. In some embodiments, the receptor binding potency and/or cellular activation potency of the modified peptides described herein is increased by 10-90%, 10-20%, 10-50%, 20-80%, 20-40%, 20-30%, 30-60%, 30-50%, 30-40%, 10-30%, 15-30%, 15-45%, 50-75%, 60-75%, 70-90%, or 80-100% when compared with the unmodified peptide. In some embodiments, the receptor binding potency and/or cellular activation potency of the modified peptides described herein is increased by 5%, 10%, 15%, 20%, 25%, 30%, 35%, 40%, 45%, 50%, 55%, 60%, 65%, 70%, 75%, 80%, 85%, 90%, 95%, 98%, 100%, 200%, 300%, 400%, 500%, 600%, 700%, 800$, 900%, 1000%, greater than 5%, greater than 10%, greater than 15%, greater than 20%, greater than 25%, greater than 30%, greater than 35%, greater than 40%, greater than 45%, greater than 50%, greater than 55%, greater than 60%, greater than 65%, greater than 70%, greater than 75%, greater than 80%, greater than 85%, greater than 90%, greater than 95%, greater than 98%, at least 2%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 98% when compared with the unmodified peptide.

In some embodiments, any of the modified peptides described herein displays improved cellular activation potency compared to the unmodified peptide. In some embodiments, the cellular activation potency of the modified peptides described herein is increased by 10-90%, 10-20%, 10-50%, 20-80%, 20-40%, 20-30%, 30-60%, 30-50%, 30-40%, 10-30%, 15-30%, 15-45%, 50-75%, 60-75%, 70-90%, or 80-100% when compared with the unmodified peptide. In some embodiments, the cellular activation potency of the modified peptides described herein is increased by 5%, 10%, 15%, 20%, 25%, 30%, 35%, 40%, 45%, 50%, 55%, 60%, 65%, 70%, 75%, 80%, 85%, 90%, 95%, 98%, 100%, 200%, 300%, 400%, 500%, 600%, 700%, 800$, 900%, 1000%, greater than 5%, greater than 10%, greater than 15%, greater than 20%, greater than 25%, greater than 30%, greater than 35%, greater than 40%, greater than 45%, greater than 50%, greater than 55%, greater than 60%, greater than 65%, greater than 70%, greater than 75%, greater than 80%, greater than 85%, greater than 90%, greater than 95%, greater than 98%, at least 2%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 98% when compared with the unmodified peptide.

GLP Peptides and Analogs

Also provided herein, in some embodiments, are reagents and intermediates for synthesis of modified peptides and/or proteins (e.g., modified GLP-1, glucagon, analogs of glucagon or GLP-1, or the like) through the incorporation of surfactants.

Provided herein, in some embodiments, are peptide products comprising a surfactant X, covalently attached to a peptide, the peptide comprising a linker amino acid U and at least one other amino acid:

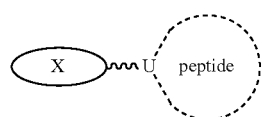

Formula 3-I-A wherein the surfactant X is a group of Formula I:

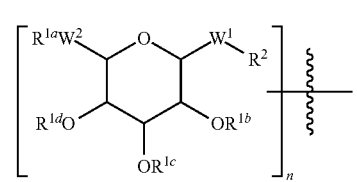

Formula 3-I wherein:
$R^{1a}$ is independently, at each occurrence, a bond, H, a substituted or unsubstituted $C_1$-$C_{30}$ alkyl group, a substituted or unsubstituted alkoxyaryl group, or a substituted or unsubstituted aralkyl group;
$R^{1b}$, $R^{1c}$, and $R^{1d}$ are each, independently at each occurrence, a bond, H, a substituted or unsubstituted $C_1$-$C_{30}$ alkyl group, a substituted or unsubstituted alkoxyaryl group, or a substituted or unsubstituted aralkyl group;
$W^1$ is independently, at each occurrence, —$CH_2$—, —$CH_2$—O—, —(C=O)—, —(C=O)—O—, —(C=O)—NH—, —(C=S)—, —(C=S)—NH—, or —$CH_2$—S—;
$W^2$ is —O—, —$CH_2$— or —S—;
$R^2$ is independently, at each occurrence, a bond, H, a substituted or unsubstituted $C_1$-$C_{30}$ alkyl group, a substituted or unsubstituted alkoxyaryl group, or a substituted or unsubstituted aralkyl group, —$NH_2$, —SH, $C_2$-$C_4$-alkene, $C_2$-$C_4$-alkyne, —NH(C=O)—$CH_2$—Br, —$(CH_2)_m$-maleimide, or —$N_3$;
n is 1, 2 or 3; and
m is 1-10;
the peptide is selected from Formula 3-II:

(SEQ. ID. NO. 303)
$aa_1$-$aa_2$-$aa_3$-$aa_4$-$aa_5$-$aa_6$-$aa_7$-$aa_8$-$aa_9$-$aa_{10}$-$aa_{11}$-

$aa_{12}$-$aa_{13}$-$aa_{14}$-$aa_{15}$-$aa_{16}$-$aa_{17}$-$aa_{18}$-$aa_{19}$-$aa_{20}$-$aa_{21}$-

$aa_{22}$-$aa_{23}$-$aa_{24}$-$aa_{25}$-$aa_{26}$-$aa_{27}$-$aa_{28}$-$aa_{29}$-$aa_{30}$-$aa_{31}$-

$aa_{32}$-$aa_{33}$-$aa_{34}$-$aa_{35}$-$aa_{36}$-$aa_{37}$-Z   FORMULA 3-II wherein:
Z is OH, or —NH—$R^3$, wherein $R^3$ is H or $C_1$-$C_{12}$ substituted or unsubstituted alkyl, or a PEG chain of less than 10 Da;
$aa_1$ is His, N—Ac-His, pGlu-His, or N—$R^3$-His;
$aa_2$ is Ser, Ala, Gly, Aib, Ac4c or Ac5c;
$aa_3$ is Gln, or Cit;
$aa_4$ is Gly, or D-Ala;
$aa_5$ is Thr, or Ser;
$aa_6$ is Phe, Trp, F2Phe, Me2Phe, or Nal2;
$aa_7$ is Thr, or Ser;
$aa_8$ is Ser, or Asp;
$aa_9$ is Asp, or Glu;
$aa_{10}$ is Tyr, Leu, Met, Nal2, Bip, or Bip2EtMeO;
$aa_{11}$ is Ser, Asn, or U;
$aa_{12}$ is Lys, Glu, Ser, Arg, or U;
$aa_{13}$ is absent or Tyr, Gln, Cit, or U;
$aa_{14}$ is absent or Leu, Met, Nle, or U;
$aa_{15}$ is absent or Asp, Glu, or U;
$aa_{16}$ is absent or Ser, Gly, Glu, Aib, Ac5c, Lys, Arg, or U;
$aa_{17}$ is absent or Arg, hArg, Gln, Glu, Cit, Aib, Ac4c, Ac5c, or U;
$aa_{18}$ is absent or Arg, hArg, Ala, Aib, Ac4c, Ac5c, or U;
$aa_{19}$ is absent or Ala, Val, Aib, Ac4c, Ac5c, or U;

$aa_{20}$ is absent or Gln, Lys, Arg, Cit, Glu, Aib, Ac4c, Ac5c, or U;
$aa_{21}$ is absent or Asp, Glu, Leu, Aib, Ac4c Ac5c, or U;
$aa_{22}$ is absent or Phe, Trp, Nal2, Aib, Ac4c, Ac5c, or U
$aa_{23}$ is absent or Val, Ile, Aib, Ac4c, Ac5c, or U;
$aa_{24}$ is absent or Gln, Ala, Glu, Cit, or U;
$aa_{25}$ is absent or Trp, Nal2, or U;
$aa_{26}$ is absent or Leu, or U;
$aa_{27}$ is absent or Met, Val, Nle, Lys, or U;
$aa_{28}$ is absent or Asn, Lys, or U;
$aa_{29}$ is absent or Thr, Gly, Aib, Ac4c, Ac5c, or U;
$aa_{30}$ is absent or Lys, Aib, Ac4c, Ac5c, or U;
$aa_{31}$ is absent or Arg, Aib, Ac4c, Ac5c, or U;
$aa_{32}$ is absent or Asn, Aib, Ac4c, Ac5c, or U;
$aa_{33}$ is absent or Arg, Aib, Ac4c, Ac5c, or U;
$aa_{34}$ is absent or Asn, Aib, Ac4c, Ac5c, or U;
$aa_{35}$ is absent or Asn, Aib, Ac4c, Ac5c, or U;
$aa_{36}$ is absent or Ile, Aib, Ac4c, Ac5C, or U;
$aa_{36}$ is absent or Ala, Aib, Ac4c, Ac5C, or U;
$aa_{37}$ absent or U;
U is a natural or unnatural amino acid comprising a functional group used for covalent attachment to the surfactant X;
wherein any two of $aa_1$-$aa_{37}$ are optionally cyclized through their side chains to form a lactam linkage; and provided that one, or at least one of $aa_{11}$-$aa_{37}$ is the linker amino acid U covalently attached to X.

In some embodiments, n is 1. In some embodiments, n is 2, and a first glycoside is attached to a second glycoside via bond between $W^2$ of the first glycoside and any one of $OR^{1b}$, $OR^{1c}$ or $OR^{1d}$ of the second glycoside. In some embodiments, n is 3, and a first glycoside is attached to a second glycoside via bond between $W^2$ of the first glycoside and any one of $OR^{1b}$, $OR^{1c}$ or $OR^{1d}$ of the second glycoside, and the second glycoside is attached to a third glycoside via bond between $W^2$ of the second glycoside and any one of $OR^{1b}$, $OR^{1c}$ or $OR^{1d}$ of the third glycoside.

In one embodiment, compounds of Formula I-A are compounds wherein X has the structure:

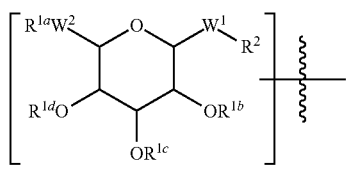

Formula 3-I wherein:
$R^{1a}$ is H, a protecting group, a substituted or unsubstituted $C_1$-$C_{30}$ alkyl group, or a steroid nucleus containing moiety;
$R^{1b}$, $R^{1c}$, and $R^{1d}$ are each, independently at each occurrence, H, a protecting group, or a substituted or unsubstituted $C_1$-$C_{30}$ alkyl group;
$W^1$ is independently, at each occurrence, —$CH_2$—, —$CH_2$—O—, —(C=O)—, —(C=O)—O—, —(C=O)—NH—, —(C=S)—, —(C=S)—NH—, or —$CH_2$—S—;
$W^2$ is —O—, —S—;
$R^2$ is a bond, $C_2$-$C_4$-alkene, $C_2$-$C_4$-alkyne, or —$(CH_2)_m$-maleimide; and
m is 1-10.

In another embodiment, compounds of Formula I-A are compounds wherein X has the structure:

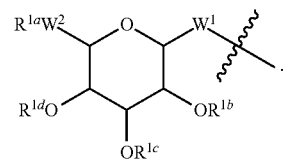

Accordingly, in the embodiment described above, $R^2$ is a bond.

For instance, in an exemplary embodiment of the structure of X described above, $W^1$ is —C(=O)NH—, $R^2$ is a bond between $W^1$ and an amino acid residue U within the peptide (e.g., an amino group in the sidechain of a lysine residue present in the peptide).

In a further embodiment, compounds of Formula I-A are compounds wherein X has the structure:

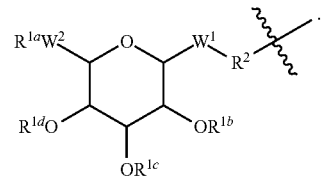

For instance, in an exemplary embodiment of the structure of X described above, $W^1$ is —$CH_2$— and $R^2$ is an alkyl-linked maleimide functional group on X and $R^2$ is attached to a suitable moiety of an amino acid residue U within the peptide (e.g., a thiol group in a cysteine residue of the peptide forms a thioether with the maleimide on X).

In yet another embodiment, compounds of Formula I-A are compounds wherein X has the structure:

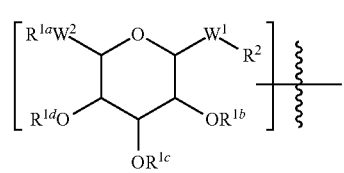

Formula 3-I wherein:
$R^{1a}$ is H, a protecting group, a substituted or unsubstituted $C_1$-$C_{30}$ alkyl group, or a steroid nucleus containing moiety;
$R^{1b}$, $R^{1c}$, and $R^{1d}$ are each, independently at each occurrence, H, a protecting group, or a substituted or unsubstituted $C_1$-$C_{30}$ alkyl group;
$W^1$ is —(C=O)—NH—;
$W^2$ is —O—;
$R^2$ is a bond.

In an additional embodiment, compounds of Formula I-A are compounds wherein X has the structure:

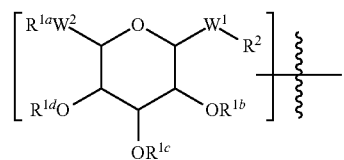

Formula 3-I wherein:
$R^{1a}$ is a substituted or unsubstituted $C_1$-$C_{30}$ alkyl group;
$R^{1b}$, $R^{1c}$, and $R^{1d}$ are H;
$W^1$ is —(C=O)—NH—;
$W^2$ is —O—; and
$R^2$ is a bond.

In some embodiments described above and herein, $R^{1a}$ is a substituted or unsubstituted $C_1$-$C_{30}$ alkyl group.

In some embodiments described above and herein, $R^{1a}$ is a substituted or unsubstituted $C_6$-$C_{20}$ alkyl group.

Also contemplated herein are alternate embodiments wherein X in Formula 3-I-A has the structure:

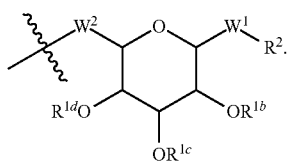

For instance, in an exemplary embodiment of the structure of X described above, $W^1$ is —S—, $R^2$ is a $C_1$-$C_{30}$ alkyl group, $W^2$ is S, $R^{1a}$ is a bond between $W^2$ and a suitable moiety of an amino acid residue U within the peptide (e.g., a thiol group in a cysteine residue of the peptide forms a thioether with X).

In another exemplary embodiment of the structure of X described above, $W^1$ is —O—, $R^2$ is a $C_1$-$C_{30}$ alkyl group, $W^2$ is O, $R^{1a}$ is a bond between $W^2$ and a suitable moiety of an amino acid residue U within the peptide (e.g., a hydroxyl group in a serine or threonine residue of the peptide forms an ether with X).

In some embodiments, U is used for covalent attachment to X and is a dibasic natural or unnatural amino acid, a natural or unnatural amino acid comprising a thiol, an unnatural amino acid comprising a —$N_3$ group, an unnatural amino acid comprising an acetylenic group, or an unnatural amino acid comprising a —NH—C(=O)—$CH_2$—Br or a —$(CH_2)$m-maleimide, wherein m is 1-10.

In some embodiments of the peptide product, the surfactant is a 1-alkyl glycoside class surfactant. In some embodiments of the peptide product, the surfactant is attached to the peptide via an amide bond.

In some embodiments of the peptide product, the surfactant X is comprised of 1-eicosyl beta-D-glucuronic acid, 1-octadecyl beta-D-glucuronic acid, 1-hexadecyl beta-D-glucuronic acid, 1-tetradecylbeta D-glucuronic acid, 1-dodecyl beta D-glucuronic acid, 1-decyl beta-D-glucuronic acid, 1-octyl beta-D-glucuronic acid, 1-eicosyl beta-D-diglucuronic acid, 1-octadecyl beta-D-diglucuronic acid, 1-hexadecyl beta-D-diglucuronic acid, 1-tetradecyl beta-D-diglucuronic acid, 1-dodecyl beta-D-diglucuronic acid, 1-decyl beta-D-diglucuronic acid, 1-octyl beta-D-diglucuronic acid, or functionalized 1-ecosyl beta-D-glucose, 1-octadecyl beta-D-glucose, 1-hexadecyl beta-D-glucose, 1-tetradecyl beta-D-glucose, 1-dodecyl beta-D-glucose, 1-decyl beta-D-glucose, 1-octyl beta-D-glucose, 1-eicosyl beta-D-maltoside, 1-octadecyl beta-D-maltoside, 1-hexadecyl beta-D-maltoside, 1-dodecyl beta-D-maltoside, 1-decyl beta-D-maltoside, 1-octyl beta-D-maltoside, and the like, and the peptide product is prepared by formation of a linkage between the aforementioned groups and a group on the peptide (e.g., a —COOH group in the aforementioned groups and an amino group of the peptide).

In some embodiments of the peptide product, U is a terminal amino acid of the peptide. In some embodiments of the peptide product, U is a non-terminal amino acid of the peptide. In some embodiments of the peptide product, U is a natural D- or L-amino acid. In some embodiments of the peptide product, U is an unnatural amino acid. In some embodiments of the peptide product, U is selected from Lys, Cys, Orn, or an unnatural amino acid comprising a functional group used for covalent attachment to the surfactant X.

In some embodiments of the peptide product, the functional group used for covalent attachment of the peptide to the surfactant X is —$NH_2$, —SH, —OH, —$N_3$, haloacetyl, a —$(CH_2)_m$-maleimide (wherein m is 1-10), or an acetylenic group.

In some embodiments side chain functional groups of two different amino acid residues are linked to form a cyclic lactam. For example, in some embodiments, a Lys side chain forms a cyclic lactam with the side chain of Glu. In some embodiments such lactam structures are reversed and are formed from a Glu and a Lys. Such lactam linkages in some instances are known to stabilize alpha helical structures in peptides (Condon, S. M., et al. (2002) Bioorg Med Chem 10: 731-736; Murage, E. N., et al (2008) Bioorg Med Chem 16: 10106-12); Murage, E. N., et al. (2010) J Med Chem 53: 6412-20). In some embodiments cysteine residues may be linked through disulfide formation in order to accomplish a similar form of conformational restriction and assist in the formation of helical structures (Li, Y., et al. (2011) Peptides 32: 1400-1407. In some embodiments side chain functional groups of two different amino acid residues are linked to form a heterocycle generated through a "click reaction" between side chain azide and alkyne functional groups in order to achieve a similar form of conformational restriction and stabilized helical conformations (Le Chevalier Isaad A., et al. (2009) J Peptide Sci 15: 451-4).

In some embodiments, the peptide product comprising a covalently linked alkyl glycoside is a covalently modified glucagon or analog thereof. In some of such embodiments, the peptide product contains a covalently linked 1-O-alkyl β-D-glucuronic acid and the peptide is an analog of glucagon.

In some embodiments, a peptide product comprising a covalently linked alkyl glycoside is a covalently modified GLP-1, or analog thereof. In some of such embodiments, the peptide product comprises a covalently linked 1-O-alkyl β-D-glucuronic acid and the peptide is an analog of GLP-1.

In some embodiments, the peptide product of Formula I-A has the structure of Formula III-A (SEQ. ID. NO. 304)
$aa_1$-$aa_2$-$aa_3$-$aa_4$-$aa_5$-$aa_6$-$aa_7$-$aa_8$-$aa_9$-$aa_{10}$-$aa_{11}$-

$aa_{12}$-$aa_{13}$-$aa_{14}$-$aa_{15}$-$aa_{16}$-$aa_{17}$-$aa_{18}$-$aa_{19}$-$aa_{20}$-

$aa_{21}$-$aa_{22}$-$aa_{23}$-$aa_{24}$-$aa_{25}$-$aa_{26}$-$aa_{27}$-$aa_{28}$-$aa_{29}$-Z

Formula 3-III-A wherein:
Z is OH, or —NH—$R^3$, wherein $R^3$ is H, or $C_1$-$C_{12}$ substituted or unsubstituted alkyl, or a PEG chain of less than 10 Da;
$aa_1$ is His, N—Ac-His, pGlu-His, or N—$R^3$-His;
$aa_2$ is Ser, Ala, Gly, Aib, Ac4c, or Ac5c;
$aa_3$ is Gln, or Cit;
$aa_4$ is Gly, or D-Ala;
$aa_5$ is Thr, or Ser;

aa$_6$ is Phe, Trp, F2Phe, Me2Phe, or Nal2;
aa$_7$ is Thr, or Ser;
aa$_8$ is Ser, or Asp;
aa$_9$ is Asp, or Glu;
aa$_{10}$ is Tyr, Leu, Met, Nal2, Bip, or Bip2EtMeO;
aa$_{11}$ is Ser, Asn, or U;
aa$_{12}$ is Lys, Glu, Ser, Arg, or U(X);
aa$_{13}$ is absent or Tyr, Gln, Cit, or U(X);
aa$_{14}$ is absent or Leu, Met, Nle, or U(X);
aa$_{15}$ is absent or Asp, Glu, or U(X);
aa$_{16}$ is absent or Ser, Gly, Glu, Aib, Ac5c, Lys, Arg, or U(X);
aa$_{17}$ is absent or Arg, hArg, Gln, Glu, Cit, Aib, Ac4c, Ac5c, or U(X);
aa$_{18}$ is absent or Arg, hArg, Ala, Aib, Ac4c, Ac5c, or U(X);
aa$_{19}$ is absent or Ala, Val, Aib, Ac4c, Ac5c, or U(X);
aa$_{20}$ is absent or Gln, Lys, Arg, Cit, Glu, Aib, Ac4c, Ac5c, or U(X);
aa$_{21}$ is absent or Asp, Glu, Leu, Aib, Ac4c, Ac5c, or U(X);
aa$_{22}$ is absent or Phe, Trp, Nal2, Aib, Ac4c, Ac5c, or U(X);
aa$_{23}$ is absent or Val, Ile, Aib, Ac4c, Ac5c, or U(X);
aa$_{24}$ is absent or Gln, Ala, Glu, Cit, or U(X);
aa$_{25}$ is absent or Trp, Nal2, or U(X);
aa$_{26}$ is absent or Leu, or U(X);
aa$_{27}$ is absent or Met, Val, Nle, Lys, or U(X);
aa$_{28}$ is absent or Asn, Lys, or U(X);
aa$_{29}$ is absent or Thr, Gly, Aib, Ac4c, Ac5c, or U(X);
wherein any two of aa$_1$-aa$_{29}$ are optionally cyclized through their side chains to form a lactam linkage; and provided that one, or at least one of aa$_{16}$, aa$_{17}$, aa$_{18}$, aa$_{19}$, aa$_{20}$, aa$_{21}$, aa$_{22}$, aa$_{23}$, aa$_{24}$, aa$_{25}$, aa$_{26}$, aa$_{27}$, aa$_{28}$ or aa$_{29}$ is the natural or unnatural amino acid U covalently attached to X.

In some embodiments, the peptide product of Formula I-A has the structure of Formula 3-III-B:

(SEQ. ID. NO. 305)
His$_1$-aa$_2$-aa$_3$-Gly$_4$-Thr$_5$-aa$_6$-Thr$_7$-Ser$_8$-Asp$_9$-aa$_{10}$- aa$_{11}$-aa$_{12}$-aa$_{13}$-aa$_{14}$-aa$_{15}$-aa$_{16}$-aa$_{17}$-aa$_{18}$-aa$_{19}$- aa$_{20}$-aa$_{21}$-aa$_{22}$-aa$_{23}$-Z    Formula 3-III-B wherein:
Z is OH, or —NH—R$^3$, wherein R$^3$ is H or substituted or unsubstituted C$_1$-C$_{12}$ alkyl; or a PEG chain of less than 10 Da;
aa$_2$ is Ser, Ala, Gly, Aib, Ac4c, or Ac5c;
aa$_3$ is Gln, or Cit;
aa$_6$ is Phe, Trp, F2Phe, Me2Phe, MePhe, or Nal2;
aa$_{10}$ is Tyr, Leu, Met, Nal2, Bip, or Bip2EtMeO;
aa$_{11}$ is Ser, Asn, or U(X);
aa$_{12}$ is Lys, Glu, Ser, or U(X);
aa$_{13}$ is absent or Tyr, Gln, Cit, or U(X);
aa$_{14}$ is absent or Leu, Met, Nle, or U(X);
aa$_{15}$ is absent or Asp, Glu, or U(X);
aa$_{16}$ is absent or Ser, Gly, Glu, Aib, Ac4c, Ac5c, Lys, R, or U(X);
aa$_{17}$ is absent or Arg, hArg, Gln, Glu, Cit, Aib, Ac4c, Ac5c, or U(X);
aa$_{18}$ is absent or Arg, hArg, Ala, Aib, Ac4c, Ac5c, or U(X);
aa$_{19}$ is absent or Ala, Val, Aib, Ac4c, Ac5c, or U(X);
aa$_{20}$ is absent or Gln, Lys, Arg, Cit, Glu, Aib, Ac4c, Ac5c, or U(X);
aa$_{21}$ is absent or Asp, Glu, Leu, Aib, Ac4c, Ac5c, or U(X);
aa$_{22}$ is absent or Phe, Aib, Ac4c, Ac5c, or U(X)
aa$_{23}$ is absent or Val, Ile, Aib, Ac4c, Ac5c, or U(X);
wherein any two of aa$_1$-aa$_{23}$ are optionally cyclized through their side chains to form a lactam linkage; and provided that one, or at least one of aa$_{16}$, aa$_{17}$, aa$_{18}$, aa$_{19}$, aa$_{20}$, aa$_{21}$, aa$_{22}$, aa$_{23}$ or aa$_{24}$ is the natural or unnatural amino acid U covalently attached to X.

In some embodiments of Formula 3-I-A, 3-III-A, 3-III-B or Formula 3-V, U is any linker amino acid described herein.

In some embodiments of Formula 3-I-A, 3-III-A, 3-III-B or Formula 3-V, U is any linker amino acid described herein.

In some embodiments of Formula 3-I-A, 3-III-A, 3-III-B or Formula 3-V, aa$_{12}$ is lysine. In some embodiments of Formula 3-I-A, 3-III-A, 3-III-B or Formula 3-V, aa$_{14}$ is leucine.

In some embodiments of Formula 3-I-A, 3-III-A, 3-III-B or Formula 3-V, aa$_{12}$ is lysine. In some embodiments of Formula I-A, III-A, III-B or Formula V, aa$_{14}$ is leucine.

In some embodiments of Formula 3-I-A, 3-III-A, 3-III-B or Formula 3-V, aa$_{18}$ is a lysine residue attached to X.

In some embodiments of Formula 3-I-A, 3-III-A, 3-III-B or Formula 3-V, aa$_{17}$ is a homo Arginine (hArg) residue.

In some embodiments of Formula I-A, III-A, III-B or Formula V, aa$_{17}$ is a glycine residue.

In some embodiments of Formula 3-I-A, 3-III-A, 3-III-B or Formula 3-V, aa$_2$ is an Aib or Ac4c residue.

In some embodiments of Formula 3-I-A, 3-III-A, 3-III-B or Formula 3-V, the peptide comprises one or more Aib residues.

In some embodiments of Formula 3-I-A, 3-III-A, 3-III-B or Formula 3-V, peptide comprises one or more Aib residues at the C-terminus.

In some embodiments of Formula 3-I-A, 3-III-A, 3-III-B or Formula 3-V, the peptide product has the structure (SEQ. ID. NO. 619):

His$_1$-aa$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-Aib$_{16}$-aa$_{17}$-Lys(N- omega-1'-alkyl beta-D-glucuronyl)$_{18}$-aa$_{19}$-NH$_2$;

wherein
aa$_2$ is Aib or Ac4c;
aa$_{17}$ is Arg, hArg or Gln;
aa$_{19}$ is Aib, Ac4c or Ac5c; and
alkyl is a C$_8$ to C$_{20}$ linear alkyl chain.

In some embodiments of Formula 3-I-A, 3-III-A, 3-III-B or Formula 3-V, the peptide product ha the structure (SEQ. ID. NO. 620):

His$_1$-aa$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-Aib$_{16}$-aa$_{17}$-Lys(N- omega-1'-alkyl beta-D-glucuronyl)$_{18}$-aa$_{19}$-aa$_{20}$-NH$_2$;

wherein
aa$_2$ is Aib or Ac4c,
aa$_{17}$ is Arg, hArg or Gln,
aa$_{19}$ and aa20 are individually Aib, Ac4c or Ac5c; and
alkyl is a C$_8$ to C$_{20}$ linear alkyl chain.

In some embodiments of Formula 3-I-A, 3-III-A, 3-III-B or Formula 3-V, the peptide product has the structure (SEQ. ID. NO. 621):

His$_1$-aa$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-aa$_{16}$-aa$_{17}$-Lys(N-omega-1'-alkyl beta-D-glucuronyl)$_{18}$-aa$_{19}$-NH$_2$;

wherein
   aa$_2$ is Aib or Ac4c;
   aa$_{16}$ is Aib or Ac4c;
   aa$_{17}$ is Arg, hArg or Gln;
   aa$_{19}$ is Aib, Ac4c or Ac5c; and
   alkyl is a C$_8$ to C$_{20}$ linear alkyl chain.

In some embodiments of Formula 3-I-A, 3-III-A, 3-III-B or Formula 3-V, aa$_{16}$ and aa$_{20}$ are cyclized to form a lactam linkage.

In some embodiments of Formula 3-I-A, 3-III-A, 3-III-B or Formula 3-V, the peptide product has the structure: (SEQ. ID. NO. 622)

His$_1$-aa$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-aa$_{16}$-aa$_{17}$Ala$_{18}$-Ala$_{19}$-aa$_{20}$-Glu$_{21}$-Phe$_{22}$-Ile$_{23}$-Lys(N-omega-1'-alkyl beta-D-glucuronyl)$_{24}$-Trp$_{25}$-Leu$_{26}$-aa$_{27}$-Asn$_{28}$-Thr$_{29}$-NH$_2$;

wherein
   aa$_2$ is Aib or Ac4c;
   aa$_{16}$ and aa$_{20}$ are each individually either Lys or Glu and are cyclized through their side chains to form a lactam linkage;
   aa$_{17}$ is Arg, hArg or Gln;
   aa$_{27}$ is Met or Nle; and
   alkyl is a C$_8$-C$_{20}$ linear alkyl chain.

In some embodiments of Formula 3-I-A, 3-III-A, 3-III-B or Formula 3-V, the peptide product has the structure (SEQ. ID. NO. 623):

His$_1$-aa$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-cyclic(Glu$_{16}$-Gln$_{17}$-Ala$_{18}$-Ala$_{19}$-Lys$_{20}$)-Glu$_{21}$-Phe$_{22}$-Ile$_{23}$-Lys(N-omega-1'-alkyl beta-D-glucuronyl)$_{24}$-Trp$_{25}$-Leu$_{26}$-Met$_{27}$-Asn$_{28}$-aa$_{29}$-NH$_2$;

wherein aa$_2$ is Aib or Ac4c, aa29 is Thr, Aib, Ac4c, or Ac5c, and the 1'-alkyl group is selected from dodecyl, tetradecyl, hexadecyl, or octadecyl; and the side chains on the amino acids in position 16 and 20 are cyclized to form a side chain lactam.

In some embodiments of Formula 3-I-A, 3-III-A, 3-III-B or Formula 3-V, aa$_{12}$ and aa$_{16}$ are cyclized to form a lactam linkage.

In some embodiments of Formula 3-I-A, 3-III-A, 3-III-B or Formula 3-V, the peptide product has the structure (SEQ. ID. NO. 624):

His$_1$-aa$_2$-Gln$_3$-Gly$_4$-Thr$_5$-Phe$_6$-Thr$_7$-Ser$_8$-Asp$_9$-Tyr$_{10}$-Ser$_{11}$-aa$_{12}$-Tyr$_{13}$-Leu$_{14}$-Asp$_{15}$-aa$_{16}$-aa$_{17}$-Lys(N-omega-1'-alkyl beta-D-glucuronyl)$_{18}$-aa$_{19}$-aa$_{20}$-NH$_2$;

wherein
   aa2 is Aib or Ac4c;
   aa$_{12}$ and aa$_{16}$ are each individually either Lys or Glu and are cyclized through their side chains to form a lactam linkage;
   aa$_{17}$ is Arg, or hArg;
   aa$_{19}$ and aa$_{20}$ are individually either Aib, Ac4c or Ac5c; and
   alkyl is a C$_8$-C$_{20}$ linear alkyl chain.

In some embodiments of Formula 3-I-A, 3-III-A, 3-III-B or Formula 3-V, the peptide product has the structure (SEQ. ID. NO. 625):

His$_1$-Ac4c$_2$-Gln$_3$-Gly$_4$-Thr$_5$-Phe$_6$-Thr$_7$-Ser$_8$-Asp$_9$-Tyr$_{10}$-Ser$_{11}$-cyclo(Glu$_{12}$-Tyr$_{13}$-Leu$_{14}$-Asp$_{15}$-Lys$_{16}$)-aa$_{17}$-Lys(N-omega-1'-alkyl beta-D-glucuronyl)$_{18}$-Aib$_{19}$-Aib$_{20}$-NH$_2$;

wherein
   aa$_{12}$ and aa$_{16}$ are cyclized through their side chains to form a lactam linkage;
   aa$_{17}$ is Arg or hArg; and
   alkyl is a C$_{12}$, C$_{14}$, C$_{16}$, or C$_{18}$ linear alkyl chain.

In some embodiments of Formula 3-I-A, 3-III-A, 3-III-B or Formula 3-V, the peptide product has the structure (SEQ. ID. NO. 626):

His$_1$-aa$_2$-Gln$_3$-Gly$_4$-Thr$_5$-Phe$_6$-Thr$_7$-Ser$_8$-Asp$_9$-Tyr$_{10}$-Ser$_{11}$-aa$_{12}$-Tyr$_{13}$-Leu$_{14}$-Asp$_{15}$-aa$_{16}$-aa$_{17}$-Lys(N-omega-1'-alkyl beta-D-glucuronyl)$_{18}$-aa$_{19}$-aa$_{20}$-NH$_2$;

wherein
   aa$_{12}$ and aa$_{16}$ are each individually either Lys or Glu and aa$_{12}$ and aa$_{16}$ are cyclized through their side chains to form a lactam linkage;
   aa$_{17}$ is Arg or hArg; aa$_{19}$ and aa$_{20}$ are individually either Aib, Ac4c or Ac5c; and the
   1'-alkyl group is selected from dodecyl, tetradecyl, hexadecyl, or octadecyl.

In some embodiments of Formula 3-I-A, 3-III-A, 3-III-B or Formula 3-V, the peptide product has the structure (SEQ. ID. NO. 627):

His$_1$-aa$_2$-Gln$_3$-Gly$_4$-Thr$_5$-aa$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Ser$_{16}$-Aib$_{17}$-Lys(N-omega-1'-dodecyl beta-D-glucuronyl)$_{18}$-aa$_{19}$-NH$_2$;

wherein aa$_2$ is Aib or Ac4c, aa$_6$ is Me2Phe, MePhe, or Phe; and aa$_{19}$ is Aib, Ac4c, or Ac5c.

In some embodiments of Formula 3-I-A, 3-III-A, 3-III-B or Formula 3-V, the peptide product has the structure (SEQ. ID. NO. 628):

His$_1$-aa$_2$-Gln$_3$-Gly$_4$-Thr$_5$-aa$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Ser$_{16}$-aa$_{17}$-Lys(N-omega-1'-dodecyl beta-D-glucuronyl)$_{18}$-aa$_{19}$-aa$_{20}$-NH$_2$;

wherein aa$_2$ is Aib or Ac4c, aa$_6$ is Me2Phe, MePhe, or Phe; aa$_{17}$ is Arg or hArg, and aa$_{19}$ or aa$_{20}$ is Aib, Ac4c, or Ac5c.

In some embodiments of Formula 3-I-A, 3-III-A, 3-III-B or Formula 3-V, the peptide product has the structure (SEQ. ID. NO. 629):

His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-cyclo(Glu$_{16}$-Arg$_{17}$-Ala$_{18}$-Ala$_{19}$-Lys$_{20}$)-Lys(N-omega-1'-alkyl beta-D-glucuronyl)$_{21}$-Phe$_{22}$-aa$_{23}$-NH$_2$;

wherein aa$_{23}$ is Aib, Ac4c, or Ac5c and the 1'-alkyl group is selected from dodecyl, tetradecyl, hexadecyl, or octadecyl.

In some embodiments of Formula 3-I-A, 3-III-A, 3-III-B or Formula 3-V, the peptide product has the structure (SEQ. ID. NO. 630):

His$_1$-aa$_2$-Gln$_3$-Gly$_4$-Thr$_5$-aa$_6$-Thr$_7$-Ser$_8$-Asp$_9$-Tyr$_{10}$-Ser$_{11}$-aa$_{12}$-Tyr$_{13}$-Leu$_{14}$-Asp$_{15}$-aa$_{16}$-aa$_{17}$-aa$_{18}$-Ala$_{19}$-aa$_{20}$-Lys(N-omega-1'-alkyl beta-D-glucuronyl)$_{21}$-Phe$_{22}$-aa$_{23}$-NH$_2$;

wherein
- aa$_2$ is Aib or Ac4c:
- aa$_6$ is Me2Phe, MePhe, or Phe;
- aa$_{12}$ and aa$_{16}$ are each individually either Lys or Glu; and aa$_{16}$ and aa$_{20}$ are cyclized through their side chains to form a lactam linkage;
- aa$_{17}$ is Arg, hArg or Gln;
- aa$_{18}$ is Aib or Ala;
- aa$_{23}$ is Aib, Ac4c, or Ac5c and the 1'-alkyl group is selected from dodecyl, tetradecyl, hexadecyl, or octadecyl.

In some embodiments of Formula 3-I-A, 3-III-A, 3-III-B or Formula 3-V, the peptide product has the structure (SEQ. ID. NO. 631):

His$_1$-aa$_2$-Gln$_3$-Gly$_4$-Thr$_5$-aa$_6$-Thr$_7$-Ser$_8$-Asp$_9$-Tyr$_{10}$-Ser$_{11}$-aa$_{12}$-Tyr$_{13}$-Leu$_{14}$-Asp$_{15}$-aa$_{16}$-aa$_{17}$-Lys(N-omega-1'-alkyl beta-D-glucuronyl)$_{18}$-aa$_{19}$-aa$_{20}$-NH$_2$;

wherein
- aa$_2$ is Aib or Ac4c:
- aa$_6$ is Phe;
- aa$_{12}$ and aa$_{16}$ are each individually either Lys or Glu; and aa$_{12}$ and aa$_{16}$ are cyclized through their side chains to form a lactam linkage;
- aa$_{17}$ is Arg or hArg;
- aa$_{19}$ is Aib, Ac4c, or Ac5c;
- aa$_{20}$ is Aib, Ac4c, or Ac5c and the and the 1'-alkyl group is selected from dodecyl, tetradecyl, hexadecyl, or octadecyl.

In some embodiments, for any compound of Formula 3-I-A, 3-III-A, 3-III-B or Formula 3-V, X is comprised of a dodecyl alkyl chain.

In some embodiments, the peptide product is a biologically active peptide product that binds to the GLP1R and/or to the GLCR.

In a specific embodiment, the peptide products of Formula 3-I-A, 3-III-A, 3-III-B or Formula 3-V, described above and herein have the following structure:

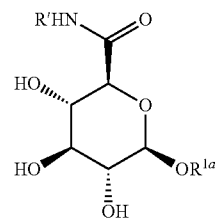

wherein R$^{1a}$ is a C$_1$-C$_{20}$ alkyl chain as described in Table 1 of FIG. 1, R' is a peptide as described in Table 3 of FIG. 8 and Table 4 of FIG. 9, W$^2$ of Formula I-A is —O—, and W$^1$ of Formula I-A is —(C=O)NH— and is part of an amide linkage to the peptide R'. In some of such embodiments, R$^{1a}$ is a C$_6$-C$_{20}$ alkyl chain. In some of such embodiments, R$^{1a}$ is a C$_8$-C$_{20}$ alkyl chain. In some of such embodiments, R$^{1a}$ is a C$_{12}$-C$_{20}$ alkyl chain. In some of such embodiments, R$^{1a}$ is a C$_{12}$-C$_{16}$ alkyl chain.

In embodiments described above, an amino moiety of an amino acid and/or a peptide R' (e.g., an amino group of an amino acid residue such as a Lysine, or a lysine residue within the peptide R') is used to form a covalent linkage with a compound of structure:

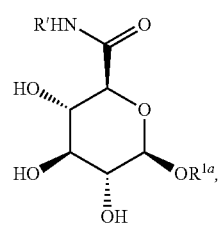

(Formula 3-A)

wherein R$^{1a}$ is a C$_1$-C$_{20}$ alkyl chain as described above and in Table 3 of FIG. 8 and Table 4 of FIG. 9.

In such cases, the amino acid residue having an amino moiety (e.g., a Lysine within the peptide R') which is used to form a covalent linkage to the compound A described above, is a linker amino acid U which is attached to a surfactant X having the structure of Formula A. Accordingly, as one example, Lys(C12) of Table 3 of FIG. 8 and Table 4 of FIG. 9 has the following structure:

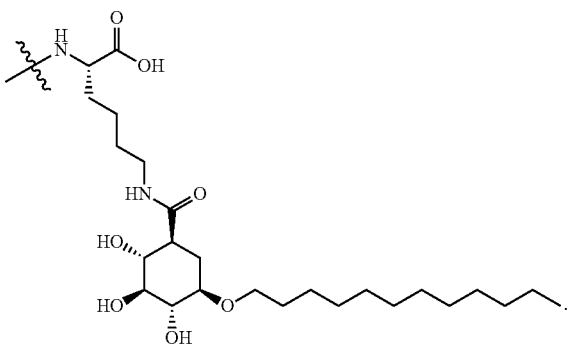 [SMILES: *N[C@@H](CCCCNC(=O)[C@H]1C[C@@H](OCCCCCCCCCCCC)[C@H](O)[C@@H](O)[C@@H]1O)C(=O)O]

Also contemplated within the scope of the embodiments presented herein are peptide products of Formula 3-I-A derived from maltouronic acid-based surfactants through binding at either or both carboxylic acid functions. Thus, as one example, peptides in Table 3 of FIG. 8 and Table 4 of FIG. 9 comprise a lysine linker amino acid bonded to a maltouronic acid based surfactant X and having a structure:

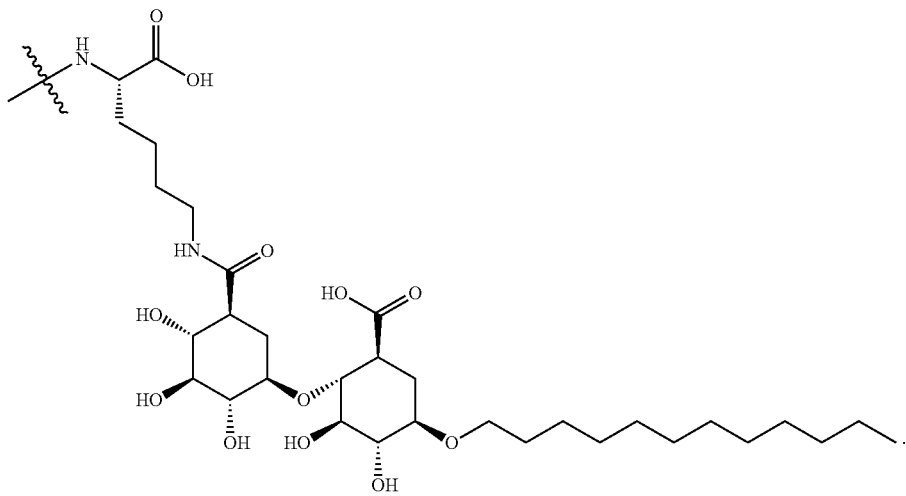 [SMILES: *N[C@@H](CCCCNC(=O)[C@H]1C[C@@H](O[C@H]2[C@H](O)[C@@H](O)[C@H](OCCCCCCCCCCCC)C[C@@H]2C(=O)O)[C@H](O)[C@@H](O)[C@@H]1O)C(=O)O]

It will be understood that in one embodiment, compounds of Formula 3-I-A are prepared by attaching a lysine to a group X, followed by attachment of additional amino acid residues and/or peptides are attached to the lysine-X compound to obtain compounds of Formula 3-I-A. It will be understood that other natural or non-natural amino acids described herein are also suitable for attachment to the surfactant X and are suitable for attaching additional amino acid/peptides to obtain compounds of Formula 3-I-A. It will be understood that in another embodiment, compounds of Formula 3-I-A are prepared by attaching a full length or partial length peptide to a group X, followed by optional attachment of additional amino acid residues and/or peptides are attached to obtain compounds of Formula 3-I-A.

In a specific embodiment, provided herein are compounds selected from compounds of Table 3 in FIG. 8 and Table 4 in FIG. 9.

Also provided herein are pharmaceutical compositions comprising a therapeutically effective amount of a peptide product described above, or acceptable salt thereof, and at least one pharmaceutically acceptable carrier or excipient.

In some embodiments of the pharmaceutical compositions, the carrier is an aqueous-based carrier. In some embodiments of the pharmaceutical compositions, the carrier is a nonaqueous-based carrier. In some embodiments of the pharmaceutical compositions, the nonaqueous-based carrier is a hydrofluoroalkane-like solvent that may comprise sub-micron anhydrous α-lactose or other excipients.

Contemplated within the scope of embodiments presented herein is the reaction of an amino acid and/or a peptide comprising a linker amino acid U bearing a nucleophile, and a group X comprising a bearing a leaving group or a functional group that can be activated to contain a leaving group, for example a carboxylic acid, or any other reacting group, thereby allowing for covalent linkage of the amino acid and/or peptide to a surfactant X via the linker amino acid U to provide a peptide product of Formula I-A.

Also contemplated within the scope of embodiments presented herein is the reaction of an amino acid and/or a peptide comprising a linker amino acid U bearing a bearing a leaving group or a functional group that can be activated to contain a leaving group, for example a carboxylic acid, or any other reacting group, and a group X comprising a nucleophilic group, thereby allowing for covalent linkage of the amino acid and/or peptide to a surfactant X via the linker amino acid U to provide a peptide product of Formula I-A.

It will be understood that, in one embodiment, Compounds of Formula 3-I-A are prepared by reaction of a linker amino acid U with X, followed by addition of further residues to U to obtain the peptide product of Formula 3-I-A. It will be understood that in an alternative embodiment, Compounds of Formula 3-I-A are prepared by reaction of a suitable peptide comprising a linker amino acid U with X, followed by optional addition of further residues to U, to obtain the peptide product of Formula 3-I-A.

Provided herein are methods for treating conditions associated with insulin resistance comprising administration of a compound of Formula 3-I-A, 3-III-A, 3-III-B or Formula 3-V.

Provided herein are methods for treating diabetes, diabetic retinopathy, diabetic neuropathy, diabetic nephropathy, wound healing, insulin resistance, hyperglycemia, hyperinsulinemia, metabolic syndrome, diabetic complications, elevated blood levels of free fatty acids or glycerol, hyperlipidemia, obesity, hypertriglyceridemia, atherosclerosis, acute cardiovascular syndrome, infarction, ischemic reperfusion or hypertension, comprising administering a therapeutically effective amount of a peptide product described above and herein to an individual in need thereof.

Provided herein are methods of reducing weight gain or inducing weight loss comprising administering to a subject in need thereof a therapeutically effective amount of a peptide product described above and herein to an individual in need thereof.

Provided herein are methods for treating mammalian conditions characterized by obesity-linked insulin resistance or the metabolic syndrome comprising administering to a subject in need thereof a weight loss-inducing or insulin-sensitizing amount of a peptide product described above and herein to an individual in need thereof.

In some embodiments, the condition to be treated is the metabolic syndrome (Syndrome X). In some embodiments, the condition to be treated is diabetes. In some embodiments, the condition to be treated is hyperlipidemia. In some embodiments, the condition to be treated is hypertension. In some embodiments, the condition to be treated is vascular disease including atherosclerosis, or the systemic inflammation characterized by elevated C reactive protein.

In some embodiments of the methods, the effective amount of the peptide product for administration is from about 0.1 μg/kg/day to about 100.0 μg/kg/day, or from 0.01 μg/kg/day to about 1 mg/kg/day or from 0.1 μg/kg/day to about 50 mg/kg/day.

Provided herein are methods of treating the metabolic syndrome, or its component diseases, comprising administering to a subject in need thereof a therapeutically effective amount of a peptide product described above. In some embodiments, the metabolic syndrome condition has progressed to diabetes.

Also provided herein is a covalently modified GLCR and/or GLP1R binding peptide or analog thereof, comprising a hydrophilic group as described herein; and a hydrophobic group covalently attached to the hydrophilic group. In specific embodiments, the covalently modified peptide and/or protein product comprises a hydrophilic group that is a saccharide and a hydrophobic group that is a $C_1$-$C_{20}$ alkyl chain or an aralkyl chain.

Insulin Resistance

The risks associated with prolonged hyperglycemia include an increased risk of microvascular complications, sensory neuropathy, myocardial infarction, stroke, macrovascular mortality, and all-cause mortality. Type 2 diabetes is also linked causally with obesity, an additional global epidemic. At least $232 billion were spent on treatment and prevention of diabetes worldwide in 2007, with three quarters of that amount spent in industrialized countries on the treatment of long-term complications and on general care, such as efforts to prevent micro and macrovascular complications. In 2007, estimated indirect costs of diabetes (disability, lost productivity, and premature death due to diabetes) to the United States economy were $58 billion.

Obesity leads to insulin resistance, a decreased ability of the cells in the body to react to insulin stimulation through decreased numbers of insulin receptors and a decreased coupling of those receptors to critical intracellular signaling systems. The obese state further leads to the "metabolic syndrome", a constellation of diseases (insulin resistance, hypertension, atherosclerosis, et al.) with very large healthcare consequences. If insulin resistance is diagnosed early enough, overt type 2 diabetes can be prevented or delayed, with lifestyle interventions aimed at reducing calorie intake and body fat and through drug treatment to normalize glycemic control. Despite treatment guidelines recommending early, aggressive intervention, many patients fail to reach targets for glycemic control. Many factors contribute to the failure to manage type 2 diabetes successfully including psychosocial and economic influences and shortcomings in the efficacy, convenience and tolerability profiles of available antidiabetic drugs. The peptide and/or protein products described herein are designed to overcome these shortcomings.

Incretin Effect

The "incretin effect" is used to describe the phenomenon whereby a glucose load delivered orally produces a much greater insulin secretion than the same glucose load administered intravenously. This effect is mediated by at least two incretin hormones secreted by intestinal L-cells. Glucose-dependent insulinotropic polypeptide (GIP) and glucagon-like peptide 1 (GLP-1) were identified as incretins and it is thought that healthy individuals may derive up to 70% of their prandial insulin secretory response from the incretin effect.

Normally the incretin peptides are secreted as needed, in response to ingested nutrients, and have a short plasma half-life due to degradation by dipeptidyl peptidase IV (DPP-4) enzyme. In people with type 2 diabetes, pancreatic responsiveness to GLP-1 is impaired, but the insulin-secretory response can be restored with pharmacologic doses of human GLP-1 (Kieffer, T. J., et al. (1995) Endocrinology 136: 3585-3596). In addition, GLP-1 promotes beta-cell neogenesis and preservation (Aaboe, K., et al. (2008) Diabetes Obes Metab 10: 994-1003). GLP-1 has additional beneficial effects such as on cardiac function: for example it improves left ventricular function (Sokos, G. G., et al. (2006) J Card Fail 12: 694-699) in human subjects. GLP-1 also slows gastric emptying in humans and reduces appetite (Toft-Nielsen, M. B., et al. (1999) Diabetes Care 22: 1137-1143).

Treatment of diabetes patients with metabolically stable and long-acting analogs of GLP-1 is described in, for example, Drab, S. R. (2010) Pharmacotherapy 30: 609-624, suffers from issues related to convenience of use and side effects such as nausea, risk of pancreatitis and thyroid carcinoma. GLP-1 analogs provide glucose-dependent stimulation of insulin secretion and lead to a reduced risk of hypoglycemia. In addition, while a number of the current treatments for diabetes cause weight gain, as described below, GLP-1 analogs induce satiety and a mild weight loss. Accordingly, in some embodiments, provided herein are GLP-1 analogs that are long acting and are administered at low doses thereby reducing side-effects associated with current treatments.

A number of peptide gut hormones are known to modulate appetite (Sanger, G. J. and Lee, K. (2008) Nat Rev Drug Discov 7: 241-254). Several peptides are derived from tissue-specific, enzymatic processing (prohormone convertases; PCs) of the preproglucagon gene product: e.g. glucagon, GLP-1, glucagon-like peptide-2 (GLP-2), glicentin and oxyntomodulin (OXM) (Drucker, D. J. (2005) Nat Clin Pract Endocrinol Metab 1: 22-31; Sinclair, E. M. and Drucker, D. J. (2005) Physiology (Bethesda) 20: 357-365). GLP-1, GLP-2, glicentin and OXM are co-secreted from L-cells in the gut in response to feeding. Preproglucagon is alternatively processed (PC2) to produce glucagon in the alpha cells in the pancreatic islets. The structure of OXM is essentially glucagon with a C-terminal extension of 8 residues.

In addition to the stimulation of insulin biosynthesis and of glucose-dependent insulin secretion, GLP-1 and its stable mimetics (e.g. Byetta) also cause modest weight loss in animal models (Mack, C. M., et al. (2006) Int J Obes (Lond) 30: 1332-1340) and in Type 2 diabetic patients (DeFronzo, R. A., et al. (2005) Diabetes Care 28: 1092-1100; Buse, J. B., et al. (2010) Diabetes Care 33: 1255-1261). Glucagon infusion reduces food intake in man (Geary, N., et al. (1992) Am J Physiol 262: R975-980), while continuous glucagon treatment of adipose tissue also promotes lipolysis (Heckemeyer, C. M., et al. (1983) Endocrinology 113: 270-276) and weight loss (Salter, J. M., et al. (1960) Metabolism 9: 753-768; Chan, E. K., et al. (1984) Exp Mol Pathol 40: 320-327). Glucagon has wide-ranging effects on energy metabolism (Heppner, K. M., et al. (2010) Physiol Behav)). Glucagon, or analogs, can be used in a diagnostic mode for temporary paralysis of the intestinal tract. Thus at least two of the products from PC processing of the preproglucagon protein are linked to satiety and metabolic effects.

In rodents, repeated intraperitoneal administration of OXM, a third product of preproglucagon, has been associated with reduced white adipose tissue and a reduction in weight compared with controls (Dakin, C. L., et al. (2004) Endocrinology 145: 2687-2695). Oxm reduced food intake by 19.3% during an intravenous infusion administration to normal-weight humans and this effect continues for more than 12 hr. after infusion (Cohen, M. A., et al. (2003) J Clin Endocrinol Metab 88: 4696-4701). Treatment of volunteers over a 4 week period resulted in a sustained satiety effect and weight loss reflecting a decrease in body fat (Wynne, K., et al. (2005) Diabetes 54: 2390-2395).

OXM is structurally homologous with GLP-1 and glucagon, and activates both the glucagon receptor (GCGR) and the GLP-1 receptor (GLP1R), but with 10 to 100 fold less potency than the eponymous ligands. In addition, study of OXM interactions with GLP1R suggest it might have different effects on beta-arrestin recruitment compared to GLP-1 (Jorgensen, R., et al. (2007) J Pharmacol Exp Ther 322: 148-154), thus acting as a "biased" ligand. A unique receptor for OXM was sought for a number of years, but has not yet been elucidated and it is assumed to act through the GLP1R and GCGR pathways. Accordingly, provided herein are methods for surfactant modification of gut peptides that allow for induction of satiety, weight loss, alleviation of insulin resistance and/or delay in progression of prediabetes to diabetes.

GLP-1

In view of the complex and interacting behavior of the products of the preproglucagon protein on satiety and metabolism described above, workers from multiple groups have studied the structure activity relationships on GLP-1 and glucagon structure. Residues throughout the sequences were shown to accept replacement. For example, replacement by Ala is well accepted in the N-terminal region of GLP-1, especially at 2, 3, 5, 8, 11, and 12 (Adelhorst, K., et al. (1994) J Biol Chem 269: 6275-6278).

It was shown that chimeric analogs with the ability to bind to GLP1R and GLCR could be achieved by grafting C-terminal residues from GLP-1 onto the N-terminus of glucagon (Hjorth, S. A., et al. (1994) J Biol Chem 269: 30121-30124). The residue at position 3 (acidic Glu in GLP1 or neutral Gln in Glucagon or OXM) reduces the affinity of glucagon (Runge, S., et al. (2003) J Biol Chem 278: 28005-28010) or OXM (Pocai, A., et al. (2009) Diabetes 58: 2258-2266) for the GlP1R. The effect on metabolic profile of animals treated with stabilized analogs of GLP-1 or glucagon or OXM with Gln in position 3 was studied (Day, J. W., et al. (2009) Nat Chem Biol 5: 749-757; Druce, M. R., et al. (2009) Endocrinology 150: 1712-1722; Pocai, A., et al. (2009) Diabetes 58: 2258-2266). These analogs were designed to have agonistic action on both GLP1R and on GCGR (Day, J. W., et al. US 2010/0190701 A1).

Chimeric analogs should have the desirable effects of the parent hormones acting on their receptors, and therefore similar to the effects of OXM, which apparently acts on both GLP-1R and GLCR: glucose-dependent insulin secretion and satiety, coupled with lipolysis and increased burning of fat due to glucagon. The analogs were shown to cause the desired effects of decreased weight and increased burning of fat. Such a profile would be attractive in the treatment of obesity, but a major challenge in obesity treatment is compliance. Although currently known full length analogs of glucagon and OXM, respectively, with affinity for both GLP-1R and GLCR can result in weight loss, these analogs are not optimized for the high bioavailability, pharmaceutical properties, and convenient delivery to patients that are necessary for optimal drug treatment regimens. Accordingly, provided herein are analogs of gut peptides (e.g., GLP, OXM, glucagon or the like) that allow for high bioavailability and/or long lasting effects for improved therapeutic outcome in treatment of conditions such as obesity and/or diabetes and/or the metabolic syndrome.

Additional factors for optimized treatment of the metabolic syndrome and diabetes with OXM-like molecules relate to the duration of treatment and the amount of glucagon action. For example, continuous treatment with analogs that activate GLP-1 and glucagon receptors (the OXM pharmacological profile) can result in very large and rapid loss of fat mass (Day, J. W., et al. (2009) Nat Chem Biol 5: 749-757), but it can also cause the loss of lean muscle mass (Kosinski, J. R., et al. (2012) Obesity (Silver Spring): doi: 10.1038/oby.2012.67), which is unfavorable for a pharmaceutical in this class. For example, in the research article by Kosinski, J. R., et al., the natural hormone Oxm is administered continuously for 14 days from an Alzet minipump and results in a decrease of 30% in fat mass, but also caused a 7% decrease in lean mass (muscle).

Glucagon action is known to stimulate glycogenolysis, lipolysis and the increased burning of fat, but can also have catabolic effects on muscle. A successful treatment using an agent that combines GLP-1 and glucagon action (the OXM profile) will need to optimally cause the satiety and potentiated glucose-dependent insulin secretion of a GLP-1 analog with a judicious amount of glucagon action (fat burning). In addition, intermittent use of such an agent will provide the desired clinical profile of moderate, continuous weight loss, through loss of fat mass, with minimized loss of lean mass. Provided herein are molecules with a desirable combination of GLP-1 and OXM action as well as a tunable pharmacokinetic/pharmacodynamic profile to allow optimum use in therapy (for example in the metabolic syndrome, diabetes, obesity, and the like).

In one embodiment, the compounds of Formula 3-I-A, 3-III-A, 3-III-B and 3-V are designed to provide either glucagon-like activity or GLP-1 like activity. In a further embodiment, the compounds of Formula 3-I-A, 3-III-A, 3-III-B and 3-V provide tunable activity. For example, in one instance, the peptide products described herein (e.g., compounds in Table 3 of FIG. 8 and Table 4 of FIG. 9) have an EC50 of less than about 500 nM, preferably less than about 50 nM, more preferably less than about 20 nM at receptors for both glucagon, and GLP-1. In another instance, the peptide products described herein (e.g., compounds in Table 3 of FIG. 8 and Table 4 of FIG. 9) are more potent (e.g., EC50 of less than 10 nM, preferably less than 5 nM, more preferably about 1 nM) for the GLP-1 receptor and less potent for the glucagon receptor (e.g., EC50 of less than 50 nM, preferably less than about 20 nM, more preferably about 5 nM) for the glucagon receptor. This tunability of biological activity allows for some retention of a judicious amount of glucagon action, thereby allowing for fat burning to occur, while also retaining the beneficial effects of potentiated glucose-dependent insulin secretion. OXM is structurally homologous with GLP-1 and glucagon, and activates both the glucagon receptor (GCGR) and the GLP-1 receptor (GLP1R). Accordingly, in some embodiments, the compounds of Formula 3-I-A, 3-III-A, 3-III-B and 3-V provide a tunable OXM-like biological activity. In some specific embodiments, the peptide products described herein comprise a peptide having amino acid residues 1-17 of GLP-1 and/or analogs thereof (e.g., analogs comprising modified non-natural amino acid replacements as described herein, cyclized lactam linkages as described herein, surfactant modifications as described herein, or a combination thereof). In some other embodiments, the peptide products described herein comprise a peptide having amino acid residues 1-16 of GLP-1 and/or analogs thereof (e.g., analogs comprising modified non-natural amino acid replacements as described herein, cyclized lactam linkages as described herein, surfactant modifications as described herein, or a combination thereof). In additional embodiments, the peptide products described herein comprise a peptide having amino acid residues 1-18 of GLP-1 and/or analogs thereof (e.g., analogs comprising modified non-natural amino acid replacements as described herein, cyclized lactam linkages as described herein, surfactant modifications as described herein, or a combination thereof). Additionally the peptide products described herein comprise one or more residues (e.g., Aib, Ac4C) which provide helix stabilization of the designed compounds of Formula 3-I-A, 3-III-A, 3-III-B and 3-V, and compounds in Table 3 of FIG. 8 and Table 4 of FIG. 9.

It is believed that the glucagon subfamily of ligands bind to their receptors in a two domain mode common to a number of the class B of receptors (secretin class, G Protein-coupled Receptors (GPCR)). For GLP-1 it is felt that there is a N-terminal region of from residue 1 to about residue 16 which binds to the tops of the transmembrane helices (juxtomembrane region) and a helical C-terminal region from 17 to 31 which binds to the large, extracellular, N-terminal extension (ECD) of the receptor. The binding of these ligands focuses on the fact that N-terminally truncated analogs of these peptide ligands can still retain substantial binding affinity and selectivity for just the isolated ECD region of the receptor. Therefore it has been suggested that the N-terminal region is responsible for receptor activation while the C-terminal region is responsible for binding. It recently has been shown that short, N-terminal analogs of GLP-1 can be both potent binders as well as receptor activators (Mapelli, C., et al. (2009) J Med Chem 52: 7788-7799; Haque, T. S., et al. (2010) Peptides 31: 950-955; Haque, T. S., et al. (2010) Peptides 31: 1353-1360).

Figure 10:
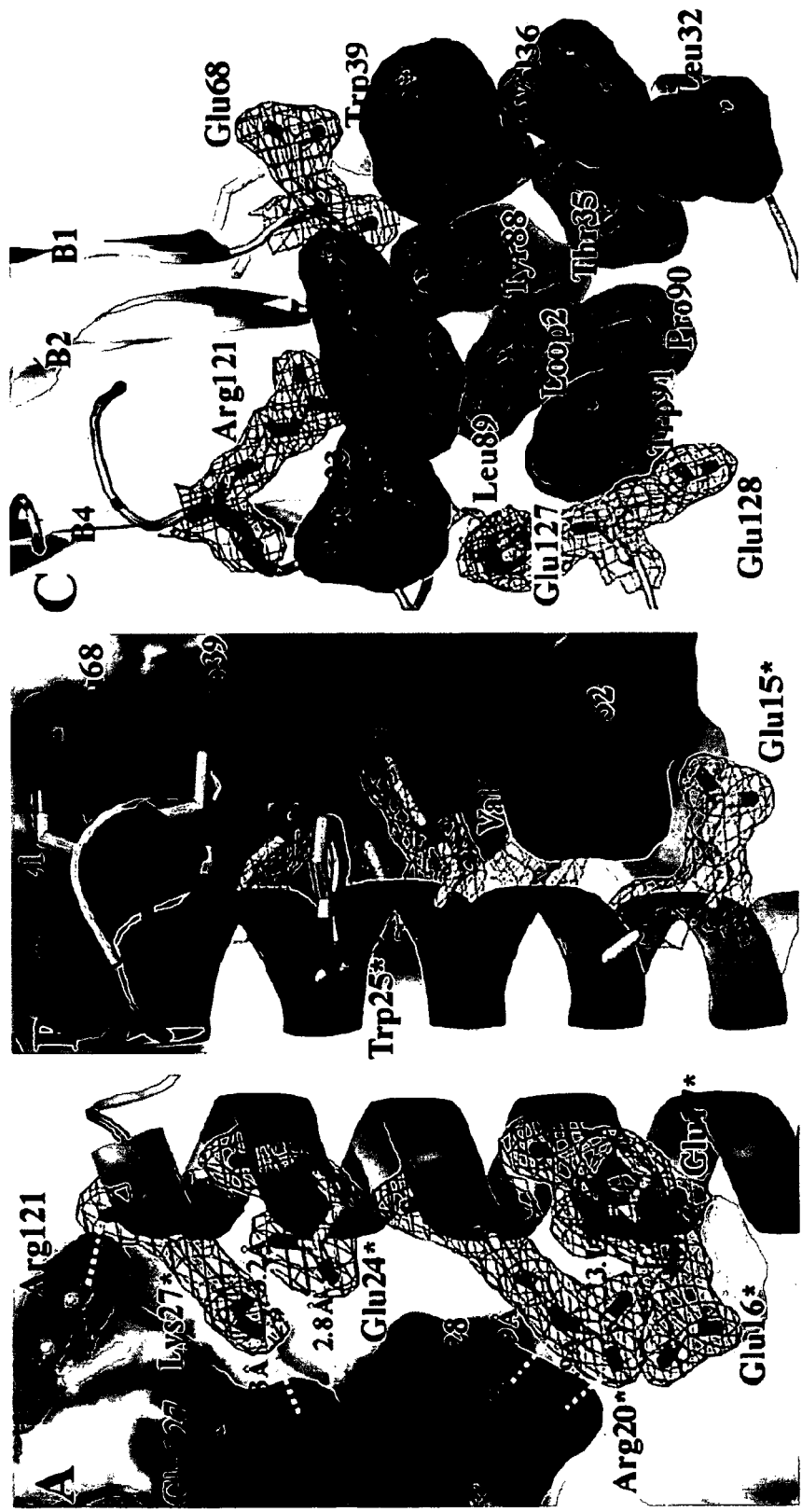
FIG. 10 illustrates the x-ray crystal structure (Runge, S., et al. (2008) J Biol Chem 283: 11340-7) of the binding site of the extracellular domain of the GLP-1 receptor and illustrates critical hydrophobic binding elements of the receptor and the ligand exendin-4 (Val$^{19*}$, Phe$^{22*}$, Trp$^{25*}$, Leu$^{26*}$) which are mimicked and replaced by the hydrophobic 1'-alkyl portion of the surfactant on the peptides of the invention.
Figure 11:
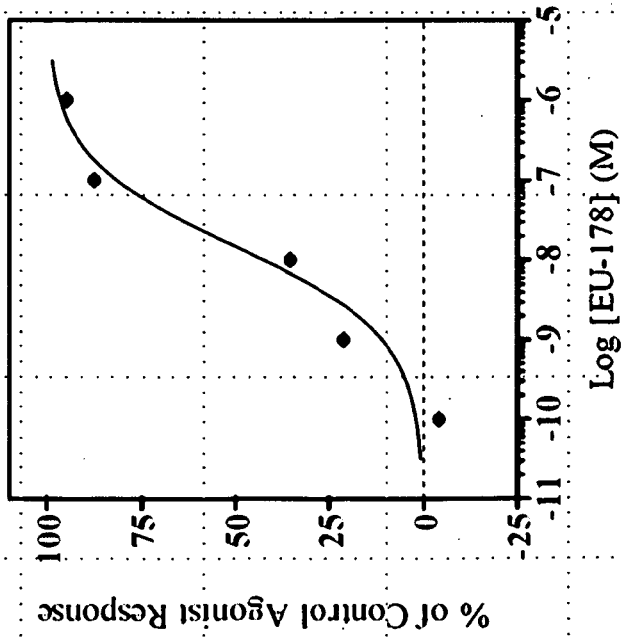
FIG. 11 shows cellular assay data of a representative compound, EU-A178, acting on cells containing the mu opioid receptor (MOP) and acting as an antagonist on the delta opioid receptor (DOP) in competition with 30 nM DPDPE. The representative compound shows potent, full agonistic behavior in the MOP agonist assay and highly potent action as a pure antagonist on the DOP receptor.
Figure 12:
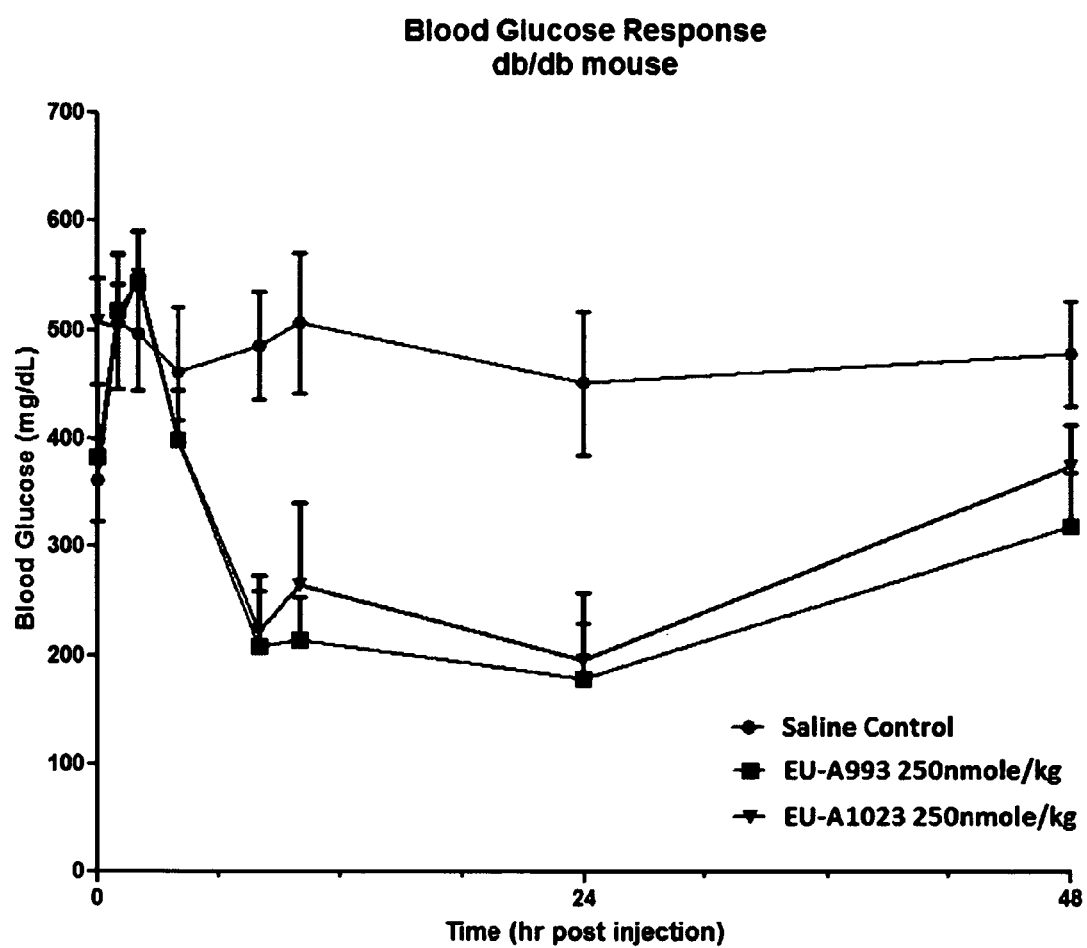
FIG. 12 illustrates the in vivo blood glucose response in db/db mice upon s.c. administration of the listed amount of test compounds of the invention (EU-A993 and EU-A1023) at times t=0, 7 hrs.
Figure 13:
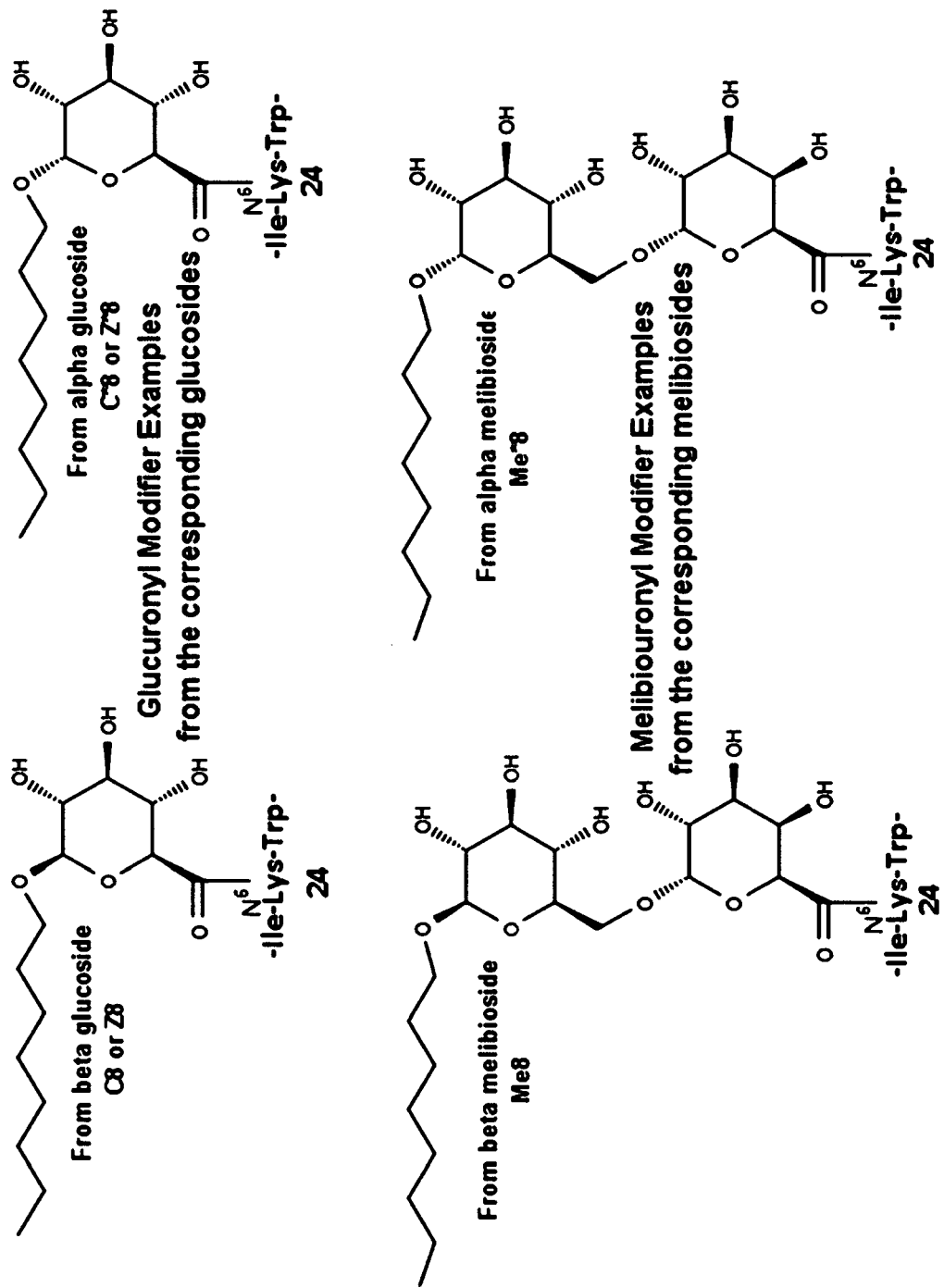
FIG. 13 illustrates examples of the detailed structure of some compounds of the invention and their linkage through the epsilon amino function of a Lys residue, in this case at position 24, to examples of mono and disaccharide surfactants modified according to one method of the invention.
Figure 14:
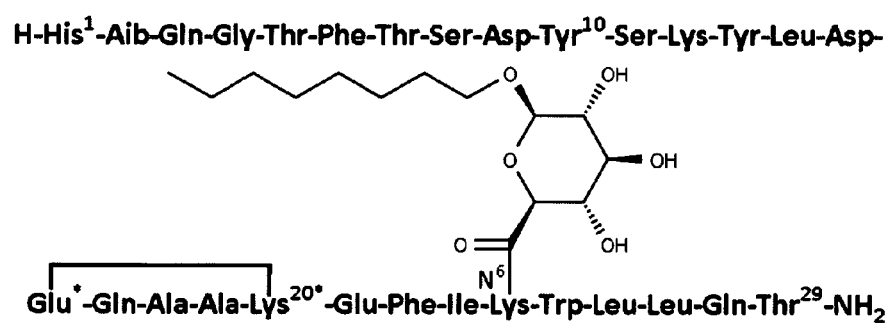
FIG. 14 illustrates the structure of EU-A937, an example of the types of structures of the invention.

In addition, study of an x-ray crystal structure (Runge, S., et al. (2008) J Biol Chem 283: 11340-7) of the N-terminal region of the GLP1R with a truncated antagonist analogs of the GLP-1 mimic, exendin-4 (Byetta), bound in this region show that a critical ligand-binding region in the ECD is of high hydrophobicity (FIG. 10). The sequence of exendin-4 beyond Glu15 interacts as an amphiphilic helix with this very hydrophobic region ($Val^{19*}$, $Phe^{22*}$, $Trp^{25*}$, $Leu^{26*}$). In one embodiment, truncated N-terminal fragments of GLP-1 or glucagon are modified to bind to GLCR and are covalently linked to a surfactant. The hydrophobic 1'-alkyl portion of the surfactant mimics and replaces the C-terminal region of the native hormone ligand and increases the peptides potency, efficacy, and duration of action. In addition, such analogs have major advantages due to their smaller size, which reduces their complexity, synthesis costs, and susceptibility to proteolysis. In addition smaller peptides are more readily absorbed through the nasal mucosa or gut enterocyte barrier.

Hypoglycemia is a condition of low blood sugar that can be life-threatening and is increasingly seen as more aggressive treatment of elevated blood sugar by intensive insulin treatment is being used in more patients. Hypoglycemia is seen when blood glucose levels drop too low to provide enough energy to the brain and muscles for the body's activities. Glucagon can be used to treat this condition and does so by stimulating the liver to break down glycogen to generate glucose and cause the blood glucose levels to rise toward the normal value. Analogs of glucagon that retain the ability to activate the GLCR may be used to achieve this desirable effect on blood glucose levels.

Analogs of GLP-1 that activate the GLP1R stimulate the production and, in the presence of elevated blood glucose levels, release of insulin from the pancreas. This action results in efficient control and normalization of blood glucose levels, as seen with current products such as exenatide (Byetta). In addition, such products appear to produce a decreased appetite and slow the movement of food from the stomach. Thus they are effective in treatment of diabetes through multiple mechanisms. Analogs that combine the effects of glucagon and GLP-1 that activate both the GLCR and the GLP1R may offer a benefit in the treatment of diabetes through a concerted action to suppress appetite, release insulin in a glucose-dependent fashion, assist in the protection from hypoglycemia and accelerate the burning of fat.

Such methods for treating hyperglycemia, including diabetes, diabetes mellitus type I, diabetes mellitus type II, or gestational diabetes, either insulin-dependent or non-insulin dependent, are expected to be useful in reducing complications of diabetes including nephropathy, retinopathy and vascular disease. Applications in cardiovascular disease encompass microvascular as well as macrovascular disease (Davidson, M. H., (2011) Am J Cardiol 108[suppl]:33B-41B; Gejl, M., et al. (2012) J Clin Endocrinol Metab 97:doi:10.1210/jc.2011-3456), and include treatment for myocardial infarction. Such methods for reducing appetite or promoting loss of body weight are expected to be useful in reducing body weight, preventing weight gain, or treating obesity of various causes, including drug-induced obesity, and reducing complications associated with obesity including vascular disease (coronary artery disease, stroke, peripheral vascular disease, ischemia reperfusion, etc.), hypertension, onset of diabetes type II, hyperlipidemia and musculoskeletal diseases.

As used herein, the term glucagon or GLP-1 analogs includes all pharmaceutically acceptable salts or esters thereof.

In one aspect, the peptides that are covalently modified and are suitable for methods described herein are truncated analogs of glucagon and/or the related hormone GLP-1, including and not limited to:

Glucagon:

(SEQ. ID. NO. 632)
$His_1$-$Ser_2$-$Gln_3$-$Gly_4$-$Thr_5$ $Phe_6$-$Thr_7$-$Ser_8$-$Asp_9$-

$Tyr_{10}$-$Ser_{11}$-$Lys_{12}$-$Tyr_{13}$-$Leu_{14}$-$Asp_{15}$-$Ser_{16}$-$Arg_{17}$-

$Arg_{18}$-$Ala_{19}$-$Gln_{20}$-$Asp_{21}$-$Phe_{22}$-$Val_{23}$-$Gln_{24}$-$Trp_{25}$-

$Leu_{26}$-$Met_{27}$-$Asn_{28}$-$Thr_{29}$

Oxyntomodulin:

(SEQ. ID. NO. 633)
$His_1$-$Ser_2$-$Gln_3$-$Gly_4$-$Thr_5$ $Phe_6$-$Thr_7$-$Ser_8$-$Asp_9$-

$Tyr_{10}$-$Ser_{11}$-$Lys_{12}$-$Tyr_{13}$-$Leu_{14}$-$Asp_{15}$-$Ser_{16}$-$Arg_{17}$-

$Arg_{18}$-$Ala_{19}$-$Gln_{20}$-$Asp_{21}$-$Phe_{22}$-$Val_{23}$-$Gln_{24}$-$Trp_{25}$-

$Leu_{26}$-$Met_{27}$-$Asn_{28}$-$Thr_{29}$-$Lys_{30}$-$Arg_{31}$-$Asn_{32}$-$Arg_{33}$-

$Asn_{34}$-$Asn_{35}$-$Ile_{36}$-$Ala_{37}$

GLP-1 (using glucagon numbering):

(SEQ. ID. NO. 634)
His$_1$-Ala$_2$-Glu$_3$-Gly$_4$-Thr$_5$-Phe$_6$-Thr$_7$-Ser$_8$-Asp$_9$-

Val$_{10}$-Ser$_{11}$-Ser$_{12}$-Tyr$_{13}$-Leu$_{14}$-Glu$_{15}$-Gly$_{16}$-Gln$_{17}$-

Ala$_{18}$-Ala$_{19}$-Lys$_{20}$-Glu$_{21}$-Phe$_{22}$-Ile$_{23}$-Ala$_{24}$-Trp$_{25}$-

Leu$_{26}$-Val$_{27}$-Lys$_{28}$-Gly$_{29}$-Arg$_{30}$

In some embodiments, a peptide product described herein has the structure of Formula 3-V:

(SEQ. ID. NO. 635)
aa$_1$-aa$_2$-aa$_3$-aa$_4$-aa$_5$-aa$_6$-aa$_7$-aa$_8$-aa$_9$-aa$_{10}$-aa$_{11}$- aa$_{12}$-aa$_{13}$-aa$_{14}$-aa$_{15}$-aa$_{16}$-aa$_{17}$-aa$_{18}$-aa$_{19}$-aa$_{20}$-aa$_{21}$- aa$_{22}$-aa$_{23}$-aa$_{24}$-aa$_{25}$-aa$_{26}$-aa$_{27}$-aa$_{28}$-aa$_{29}$-aa$_{30}$-aa$_{31}$- aa$_{32}$-aa$_{33}$-aa$_{34}$-aa$_{35}$-aa$_{36}$-aa$_{37}$-Z  FORMULA 3-V wherein:
U is a linking amino acid;
X is a surfactant-linked to the side chain of U;
Z is OH, or —NH—R$^3$, wherein R$^3$ is H or C$_1$-C$_{12}$ substituted or unsubstituted alkyl;
aa$_1$ is His, N—Ac-His, pGlu-His or N—R$^3$-His;
aa$_2$ is Ser, Ala, Gly, Aib, Ac4c or Ac5c;
aa$_3$ is Gln, or Cit;
aa$_4$ is Gly, or D-Ala;
aa$_5$ is Thr, or Ser;
aa$_6$ is Phe, Trp, F2Phe, Me2Phe, or Nal(2);
aa$_7$ is Thr, or Ser;
aa$_8$ is Ser, or Asp;
aa$_9$ is Asp, or Glu;
aa$_{10}$ is Tyr, Leu, Met, Nal(2), Bip, or Bip2EtMeO;
aa$_{11}$ is Ser, Asn, or U(X);
aa$_{12}$ is Lys, Glu, Ser, Arg, or U(X);
aa$_{13}$ is absent, Tyr, Gln, Cit, or U(X);
aa$_{14}$ is absent, Leu, Met, Nle, or U(X);
aa$_{15}$ is absent, Asp, Glu, or U(X);
aa$_{16}$ is absent, Ser, Gly, Glu, Aib, Ac5c, Lys, Arg, or U(X);
aa$_{17}$ is absent, Arg, hArg, Gln, Glu, Cit, Aib, Ac4c, Ac5c, or U(X);
aa$_{18}$ is absent, Arg, hArg, Ala, Aib, Ac4c, Ac5c, or U(X);
aa$_{19}$ is absent, Ala, Val, Aib, Ac4c, Ac5c, or U(X);
aa$_{20}$ is absent, Gln, Lys, Arg, Cit, Glu, Aib, Ac4c, Ac5c, or U(X);
aa$_{21}$ is absent, Asp, Glu, Leu, Aib, Ac4c, Ac5c, or U(X);
aa$_{22}$ is absent, Phe, Trp, Nal(2), Aib, Ac4c, Ac5c, or U(X);
aa$_{23}$ is absent, Val, Ile, Aib, Ac4c, Ac5c, or U(X);
aa$_{24}$ is absent, Gln, Ala, Glu, Cit, or U(X);
aa$_{25}$ is absent, Trp, Nal(2), or U(X);
aa$_{26}$ is absent, Leu, U(X);
aa$_{27}$ is absent, Met, Val, Nle, Lys, or U(X);
aa$_{28}$ is absent, Asn, Lys, or U(X);
aa$_{29}$ is absent, Thr, Gly, Aib, Ac4c, Ac5c, or U(X);
aa$_{30}$ is absent, Lys, Aib, Ac4c, Ac5c, or U(X);
aa$_{31}$ is absent, Arg, Aib, Ac4c, Ac5c, or U(X);
aa$_{32}$ is absent, Asn, Aib, Ac4c, Ac5c, or U(X);
aa$_{33}$ is absent, Arg, Aib, Ac5c, or U(X);
aa$_{34}$ is absent, Asn, Aib, Ac4c, Ac5c, or U(X);
aa$_{35}$ is absent, Asn, Aib, Ac4c, Ac5c, or U(X);
aa$_{36}$ is absent, Ile, Aib, Ac4c, Ac5C, or U(X);
aa$_{36}$ is absent, Ala, Aib, Ac4c, Ac5C, or U(X);
aa$_{37}$ absent or U(X);
provided that one, or at least one of aa$_{11}$-aa$_{37}$ is U(X).

In specific embodiments, the linking amino acid U, is a diamino acid like Lys or Orn, X is a modified surfactant from the 1-alkyl glycoside class linked to U, and Z is OH, or —NH—R$_2$, wherein R$^3$ is H or C$_1$-C$_{12}$; or a PEG chain of less than 10 Da.

In some embodiments, a peptide product described herein has the structure of Formula III-B:

(SEQ. ID. NO. 305)
His$_1$-aa$_2$-aa$_3$-Gly$_4$-Thr$_5$-aa$_6$-Thr$_7$-Ser$_8$-Asp$_9$-aa$_{10}$- aa$_{11}$-aa$_{12}$-aa$_{13}$-aa$_{14}$-aa$_{15}$-aa$_{16}$-aa$_{17}$-aa$_{18}$-aa$_{19}$-aa$_{20}$- aa$_{21}$-aa$_{22}$-aa$_{23}$-Z  FORMULA 3-III-B wherein:
Z is OH, or —NH—R$^3$, wherein R$^3$ is H or substituted or unsubstituted C$_1$-C$_{12}$ alkyl; or a PEG chain of less than 10 Da;
aa$_2$ is Ser, Ala, Gly, Aib, Ac4c, or Ac5c;
aa$_3$ is Gln, or Cit;
aa$_6$ is Phe, Trp, F2Phe, Me2Phe, MePhe, or Nal2;
aa$_{10}$ is Tyr, Leu, Met, Nal2, Bip, or Bip2EtMeO;
aa$_{11}$ is Ser, Asn, or U;
aa$_{12}$ is Lys, Glu, Ser or U(X);
aa$_{13}$ is absent or Tyr, Gln, Cit, or U(X);
aa$_{14}$ is absent or Leu, Met, Nle, or U(X);
aa$_{15}$ is absent or Asp, Glu, or U(X);
aa$_{16}$ is absent or Ser, Gly, Glu, Aib, Ac4c, Ac5c, Lys, R, or U(X);
aa$_{17}$ is absent or Arg, hArg, Gln, Glu, Cit, Aib, Ac4c, Ac5c, or U(X);
aa$_{18}$ is absent or Arg, hArg, Ala, Aib, Ac4c, Ac5c, or U(X);
aa$_{19}$ is absent or Ala, Val, Aib, Ac4c, Ac5c, or U(X);
aa$_{20}$ is absent or Gln, Lys, Arg, Cit, Glu, Aib, Ac4c, Ac5c, or U(X);
aa$_{21}$ is absent or Asp, Glu, Leu, Aib, Ac4c, Ac5c, or U(X);
aa$_{22}$ is absent or Phe, Aib, Ac4c, Ac5c, or U(X)
aa$_{23}$ is absent or Val, Ile, Aib, Ac4c, Ac5c, or U(X);
wherein any two of aa$_1$-aa$_{23}$ are optionally cyclized through their side chains to form a lactam linkage; and
provided that one, or at least one of aa$_{16}$, aa$_{17}$, aa$_{18}$, aa$_{19}$, aa$_{20}$, aa$_{21}$, aa$_{22}$, aa$_{23}$ or aa$_{24}$ is the natural or unnatural amino acid U covalently attached to X.

In some specific embodiments of Formula 3-III-A, Formula 3-III-B and Formula 3-V, X has the structure:

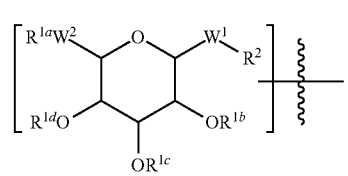

Formula 3-I wherein:
R$^{1a}$ is a substituted or unsubstituted C$_1$-C$_{30}$ alkyl group;
R$^{1b}$, R$^{1c}$, and R$^{1d}$ are H;
W$^1$ is —(C=O)—NH—;
W$^2$ is —O—; and
R$^2$ is a bond.

In some of the embodiments described above, R$^{1a}$ is a C$_1$-C$_{20}$ alkyl group, a C$_8$-C$_{20}$ alkyl group, C$_{12}$-18 alkyl group or C$_{14}$-C$_{18}$ alkyl group.

In some embodiments of Formula 3-III-B, U is any linker amino acid described herein. Table 3 of FIG. 8 and Table 4 of FIG. 9 illustrate certain examples of peptides that covalently linked with surfactants as described herein.

Contemplated within the scope of embodiments presented herein are peptide products of Formula 3-I-A, Formula 3-III-A, Formula 3-III-B or Formula 3-V, wherein the peptide product comprises one, or, more than one surfactant groups (e.g., group X having the structure of Formula 3-I). In one embodiment, a peptide product of Formula 3-I-A, Formula 3-III-A, Formula 3-III-B or Formula 3-V, comprises one surfactant group. In another embodiment, a peptide product of Formula 3-I-A, Formula 3-III-A, Formula 3-III-B or Formula 3-V, comprises two surfactant groups. In yet another embodiment, a peptide product of Formula 3-I-A, Formula 3-III-A, Formula 3-III-B or Formula 3-V, comprises three surfactant groups.

Recognized herein is the importance of certain portions of SEQ. ID. NO. 632 for the treatment of conditions associated with insulin resistance and/or cardiovascular conditions. Accordingly, provided herein is a method of treating diabetes in an individual in need thereof comprising administration of a therapeutically effective amount of a glucagon analog comprising amino acid residues $aa_1$-$aa_{17}$ of SEQ. ID. NO. 632 to the individual in need thereof.

In a further embodiment, provided herein is a method of treating diabetes in an individual in need thereof comprising administration of a therapeutically effective amount of a glucagon analog comprising amino acid residues $aa_1$-$aa_{18}$ of SEQ. ID. NO. 632 to the individual in need thereof.

In another embodiment, provided herein is a method of treating diabetes in an individual in need thereof comprising administration of a therapeutically effective amount of a glucagon analog comprising amino acid residues $aa_1$-$aa_{19}$ of SEQ. ID. NO. 632 to the individual in need thereof.

In another embodiment, provided herein is a method of treating diabetes in an individual in need thereof comprising administration of a therapeutically effective amount of a glucagon analog comprising amino acid residues $aa_1$-$aa_{20}$ of SEQ. ID. NO. 632 to the individual in need thereof.

In an additional embodiment, the administration of the said glucagon analog described above causes weight loss.

Recognized herein is the importance of certain portions of SEQ. ID. NO. 303 for the treatment of conditions associated with insulin resistance and/or cardiovascular conditions. Accordingly, provided herein is a method of treating diabetes in an individual in need thereof comprising administration of a therapeutically effective amount of a glucagon analog comprising amino acid residues $aa_1$-$aa_{17}$ of SEQ. ID. NO. 303 to the individual in need thereof.

In a further embodiment, provided herein is a method of treating diabetes in an individual in need thereof comprising administration of a therapeutically effective amount of a glucagon analog comprising amino acid residues $aa_1$-$aa_{18}$ of SEQ. ID. NO. 303 to the individual in need thereof.

In another embodiment, provided herein is a method of treating diabetes in an individual in need thereof comprising administration of a therapeutically effective amount of a glucagon analog comprising amino acid residues $aa_1$-$aa_{19}$ of SEQ. ID. NO. 303 to the individual in need thereof.

In another embodiment, provided herein is a method of treating diabetes in an individual in need thereof comprising administration of a therapeutically effective amount of a glucagon analog comprising amino acid residues $aa_1$-$aa_{20}$ of SEQ. ID. NO. 303 to the individual in need thereof.

In an additional embodiment, the administration of the said glucagon analog described above causes weight loss.

In any of the embodiments described above, the said glucagon analog is modified with a surfactant X of Formula 3-I:

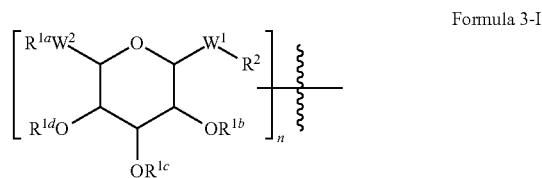

Formula 3-I wherein:
$R^{1a}$ is independently, at each occurrence, a bond, H, a substituted or unsubstituted $C_1$-$C_{30}$ alkyl group, a substituted or unsubstituted alkoxyaryl group, a substituted or unsubstituted aralkyl group, or a steroid nucleus containing moiety;
$R^{1b}$, $R^{1c}$, and $R^{1d}$ are each, independently at each occurrence, a bond, H, a substituted or unsubstituted $C_1$-$C_{30}$ alkyl group, a substituted or unsubstituted alkoxyaryl group, or a substituted or unsubstituted aralkyl group;
$W^1$ is independently, at each occurrence, —$CH_2$—, —$CH_2$—O—, —(C=O), —(C=O)—O—, —(C=O)—NH—, —(C=S)—, —(C=S)—NH—, or —$CH_2$—S—;
$W^2$ is —O—, —$CH_2$— or —S—;
$R^2$ is independently, at each occurrence, a bond to U, H, a substituted or unsubstituted $C_1$-$C_{30}$ alkyl group, a substituted or unsubstituted alkoxyaryl group, or a substituted or unsubstituted aralkyl group, —$NH_2$, —SH, $C_2$-$C_4$-alkene, $C_2$-$C_4$-alkyne, —NH(C=O)—$CH_2$—Br, —$(CH_2)_m$-maleimide, or —$N_3$;
n is 1, 2 or 3; and
m is 1-10.

In a specific embodiment, the said glucagon analog is modified with a surfactant, X having the structure:

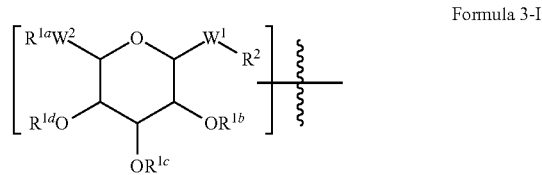

Formula 3-I wherein:
$R^{1a}$ is a substituted or unsubstituted $C_1$-$C_{30}$ alkyl group;
$R^{1b}$, $R^{1c}$, and $R^{1d}$ are H;
$W^1$ is —(C=O)—NH—;
$W^2$ is —O—; and
$R^2$ is a bond.

In some of the embodiments described above, $R^{1a}$ is a $C_1$-$C_{20}$ alkyl group, a $C_8$-$C_{20}$ alkyl group, $C_{12}$-$C_{18}$ alkyl group or $C_{14}$-$C_{18}$ alkyl group.

Also provided herein is a method of treating a cardiovascular disease in an individual in need thereof comprising administration of a therapeutically effective amount of a glucagon analog comprising amino acid residues $aa_1$-$aa_{17}$ of SEQ. ID. NO. 632 to the individual in need thereof.

Also provided herein is a method of treating a cardiovascular disease in an individual in need thereof comprising administration of a therapeutically effective amount of a glucagon analog comprising amino acid residues $aa_1$-$aa_{18}$ of SEQ. ID. NO. 632 to the individual in need thereof.

Also provided herein is a method of treating a cardiovascular disease in an individual in need thereof comprising administration of a therapeutically effective amount of a glucagon analog comprising amino acid residues $aa_1$-$aa_{19}$ of SEQ. ID. NO. 632 to the individual in need thereof.

Also provided herein is a method of treating a cardiovascular disease in an individual in need thereof comprising administration of a therapeutically effective amount of a glucagon analog comprising amino acid residues $aa_1$-$aa_{20}$ of SEQ. ID. NO. 632 to the individual in need thereof.

In some cases for the embodiments described above, the said glucagon analog is administered when the cardiovascular disease is associated with an ischemic event.

Also provided herein is a method of treating a cardiovascular disease in an individual in need thereof comprising administration of a therapeutically effective amount of a glucagon analog comprising amino acid residues $aa_1$-$aa_{17}$ of SEQ. ID. NO. 303 to the individual in need thereof.

Also provided herein is a method of treating a cardiovascular disease in an individual in need thereof comprising administration of a therapeutically effective amount of a glucagon analog comprising amino acid residues $aa_1$-$aa_{18}$ of SEQ. ID. NO. 303 to the individual in need thereof.

Also provided herein is a method of treating a cardiovascular disease in an individual in need thereof comprising administration of a therapeutically effective amount of a glucagon analog comprising amino acid residues $aa_1$-$aa_{19}$ of SEQ. ID. NO. 303 to the individual in need thereof.

Also provided herein is a method of treating a cardiovascular disease in an individual in need thereof comprising administration of a therapeutically effective amount of a glucagon analog comprising amino acid residues $aa_1$-$aa_{20}$ of SEQ. ID. NO. 303 to the individual in need thereof.

In some cases for the embodiments described above, the said glucagon analog is administered when the cardiovascular disease is associated with an ischemic event.

In any of the embodiments described above, the said glucagon analog is modified with a surfactant X of Formula 3-I:

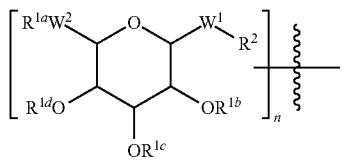

Formula 3-I wherein:
$R^{1a}$ is independently, at each occurrence, a bond, H, a substituted or unsubstituted $C_1$-$C_{30}$ alkyl group, a substituted or unsubstituted alkoxyaryl group, a substituted or unsubstituted aralkyl group, or a steroid nucleus containing moiety;
$R^{1b}$, $R^{1c}$, and $R^{1d}$ are each, independently at each occurrence, a bond, H, a substituted or unsubstituted $C_1$-$C_{30}$ alkyl group, a substituted or unsubstituted alkoxyaryl group, or a substituted or unsubstituted aralkyl group;
$W^1$ is independently, at each occurrence, —$CH_2$—, —$CH_2$—O—, —(C=O), —(C=O)—O—, —(C=O)—NH—, —(C=S)—, —(C=S)—NH—, or —$CH_2$—S—;
$W^2$ is —O—, —$CH_2$— or —S—;

$R^2$ is independently, at each occurrence, a bond to U, H, a substituted or unsubstituted $C_1$-$C_{30}$ alkyl group, a substituted or unsubstituted alkoxyaryl group, or a substituted or unsubstituted aralkyl group, —$NH_2$, —SH, $C_2$-$C_4$-alkene, $C_2$-$C_4$-alkyne, —NH(C=O)—$CH_2$—Br, —$(CH_2)_m$-maleimide, or —$N_3$;
n is 1, 2 or 3; and
m is 1-10.

In a specific embodiment, the said glucagon analog is modified with a surfactant, X having the structure:

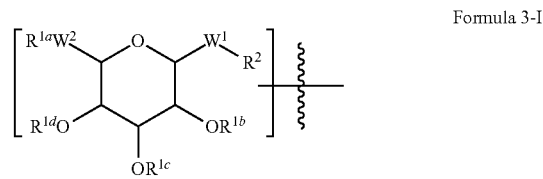

Formula 3-I wherein:
$R^{1a}$ is a substituted or unsubstituted $C_1$-$C_{30}$ alkyl group;
$R^{1b}$, $R^{1c}$, and $R^{1d}$ are H;
$W^1$ is —(C=O)—NH—;
$W^2$ is —O—; and
$R^2$ is a bond.

In some of the embodiments described above, $R^{1a}$ is a $C_1$-$C_{20}$ alkyl group, a $C_8$-$C_{20}$ alkyl group, $C_{12}$-$C_{18}$ alkyl group or $C_{14}$-$C_{18}$ alkyl group.

Modifications at the amino or carboxyl terminus may optionally be introduced into the peptides (e.g., glucagon or GLP-1) (Nestor, J. J., Jr. (2009) Current Medicinal Chemistry 16: 4399-4418). For example, the peptides can be truncated or acylated on the N-terminus to yield peptides analogs exhibiting low efficacy, partial agonist and antagonist activity, as has been seen for some peptides (Gourlet, P., et al. (1998) Eur J Pharmacol 354: 105-111, Gozes, I. and Furman, S. (2003) Curr Pharm Des 9: 483-494), the contents of which is incorporated herein by reference). For example, deletion of the first 6 residues of bPTH yields antagonistic analogs (Mahaffey, J. E., et al. (1979) J Biol Chem 254: 6496-6498; Goldman, M. E., et al. (1988) Endocrinology 123: 2597-2599) and a similar operation on peptides described herein generates potent antagonistic analogs. Other modifications to the N-terminus of peptides, such as deletions or incorporation of D-amino acids such as D-Phe also can give potent and long acting agonists or antagonists when substituted with the modifications described herein such as long chain alkyl glycosides. Such agonists and antagonists also have commercial utility and are within the scope of contemplated embodiments described herein.

Also contemplated within the scope of embodiments described herein are surfactants covalently attached to peptide analogs, wherein the native peptide is modified by acetylation, acylation, PEGylation, ADP-ribosylation, amidation, covalent attachment of a lipid or lipid derivative, covalent attachment of phosphotidylinositol, cross-linking, cyclization, disulfide bond formation, demethylation, formation of covalent cross-link formation of cysteine, formation of pyroglutamate, formylation, gamma-carboxylation, glycosylation, GPI anchor formation, hydroxylation, iodination, methylation, myristoylation, oxidation, proteolytic processing, phosphorylation, prenylation, racemization, glycosylation, lipid attachment, sulfation, gamma-carboxylation of glutamic acid residues, hydroxylation and ADP-ribosylation, selenoylation, sulfation, transfer-RNA mediated addition of amino acids to proteins, such as arginylation, and ubiquitination. See, for instance, (Nestor, J. J., Jr. (2007) Comprehensive Medicinal Chemistry II 2: 573-601, Nestor, J. J., Jr. (2009) Current Medicinal Chemistry 16: 4399-4418, Creighton, T. E. (1993, Wold, F. (1983) Posttranslational Covalent Modification of Proteins 1-12, Seifter, S. and Englard, S. (1990) Methods Enzymol 182: 626-646, Rattan, S. I., et al. (1992) Ann N Y Acad Sci 663: 48-62). Also contemplated within the scope of embodiments described herein are peptides that are branched or cyclic, with or without branching. Cyclic, branched and branched circular peptides result from post-translational natural processes and are also made by suitable synthetic methods. In some embodiments, any peptide product described herein comprises a peptide analog described above that is then covalently attached to an alkyl-glycoside surfactant moiety.

Also contemplated within the scope of embodiments presented herein are peptide chains substituted in a suitable position by the substitution of the analogs claimed herein by acylation on a linker amino acid, at for example the ε-position of Lys, with fatty acids such as octanoic, decanoic, dodecanoic, tetradecanoic, hexadecanoic, octadecanoic, 3-phenylpropanoic acids and the like, with saturated or unsaturated alkyl chains (Zhang, L. and Bulaj, G. (2012) Curr Med Chem 19: 1602-1618). Non-limiting, illustrative examples of such analogs are:

(SEQ. ID. NO. 636)
$His_1$-$Aib_2$-$Gln_3$-$Gly_4$-$Thr_5$-$Phe_6$-

$Thr_7$-$Ser_8$-$Asp_9$-$Tyr_{10}$-$Ser_{11}$-$Lys_{12}$-$Tyr_{13}$-$Leu_{14}$-

$Asp_{15}$-$Ser_{16}$-$Arg_{17}$-

Lys(N-epsilon-dodecanoyl)$_{18}$-$Aib_{19}$-$NH_2$, (SEQ. ID. NO. 637)
$His_1$-$Aib_2$-$Gln_3$-$Gly_4$-$Thr_5$-$Phe_6$-

$Thr_7$-$Ser_8$-$Asp_9$-$Tyr_{10}$-$Ser_{11}$-$Lys_{12}$-$Tyr_{13}$-$Leu_{14}$-

$Asp_{15}$-$Ser_{16}$-$Arg_{17}$-

Lys(N-epsilon-tetradecanoyl)$_{18}$-$Ac4c_{19}$-$NH_2$, (SEQ. ID. NO. 638)
$His_1$-$Aib_2$-$Gln_3$-$Gly_4$-$Thr_5$-$Phe_6$-

$Thr_7$-$Ser_8$-$Asp_9$-$Tyr_{10}$-$Ser_{11}$-$Lys_{12}$-$Tyr_{13}$-$Leu_{14}$-

$Asp_{15}$-$Ser_{16}$-$Arg_{17}$-

Lys(N-epsilon-hexadecanoyl)$_{18}$-$Aib_{19}$-$NH_2$, (SEQ. ID. NO. 639)
$His_1$-$Aib_2$-$Gln_3$-$Gly_4$-$Thr_5$-$Phe_6$-$Thr_7$-

$Ser_8$-$Asp_9$-$Tyr_{10}$-$Ser_{11}$-$Lys_{12}$-$Tyr_{13}$-$Leu_{14}$-$Asp_{15}$-

$Aib_{16}$-$Arg_{17}$-

Lys(N-epsilon-dodecanoyl)$_{18}$-$NH_2$, (SEQ. ID. NO. 640)
$His_1$-$Aib_2$-$Gln_3$-$Gly_4$-$Thr_5$-$Phe_6$-$Thr_7$-

$Ser_8$-$Asp_9$-$Tyr_{10}$-$Ser_{11}$-$Lys_{12}$-$Tyr_{13}$-$Leu_{14}$-$Asp_{15}$-

$Aib_{16}$-$Arg_{17}$-

Lys(N-epsilon-tetradecanoyl)$_{18}$-$NH_2$, (SEQ. ID. NO. 641)
$His_1$-$Aib_2$-$Gln_3$-$Gly_4$-$Thr_5$-$Phe_6$-

$Thr_7$-$Ser_8$-$Asp_9$-$Tyr_{10}$-$Ser_{11}$-$Lys_{12}$-$Tyr_{13}$-$Leu_{14}$-

$Asp_{15}$-$Aib_{16}$-$Arg_{17}$-

Lys(N-epsilon-hexadecanoyl)$_{18}$-$NH_2$, (SEQ. ID. NO. 642)
$His_1$-$Aib_2$-$Gln_3$-$Gly_4$-$Thr_5$-$Phe_6$-

$Thr_7$-$Ser_8$-$Asp_9$-$Tyr_{10}$-$Ser_{11}$-$Lys_{12}$-$Tyr_{13}$-$Leu_{14}$-

$Asp_{15}$-$Ser_{16}$-$Arg_{17}$-

Lys(N-epsilon-(gamma-glutamyl)-N- alpha-tetradecanoyl))$_{18}$-$Aib_{19}$-$NH_2$,
and the like.

In further embodiments, a peptide chain is optionally substituted in a suitable position by reaction on a linker amino acid, for example the sulfhydryl of Cys, with a spacer and a hydrophobic moiety such as a steroid nucleus, for example a cholesterol moiety. In some of such embodiments, the modified peptide further comprises one or more PEG chains. Non-limiting examples of such molecules are:

(SEQ. ID. NO. 643)
$His_1$-$Aib_2$-$Gln_3$-$Gly_4$-$Thr_5$-$Phe_6$-

$Thr_7$-$Ser_8$-$Asp_9$-$Tyr_{10}$-$Ser_{11}$-$Lys_{12}$-$Tyr_{13}$-$Leu_{14}$-

$Asp_{15}$-$Aib_{16}$-$Arg_{17}$-Cys(S-(3-(PEG4- aminoethylacetamide-Cholesterol)))$_{18}$-$Aib_{19}$-$NH_2$, (SEQ. ID. NO. 644)
$His_1$-$Aib_2$-$Gln_3$-$Gly_4$-$Thr_5$-$Phe_6$-

$Thr_7$-$Ser_8$-$Asp_9$-$Tyr_{10}$-$Ser_{11}$-cyclo($Glu_{12}$-$Tyr_{13}$-

$Leu_{14}$-$Asp_{15}$-$Lys_{16}$)-$Arg_{17}$-Cys(S-(3-(PEG4- aminoethylacetamide-Cholesterol)))$_{18}$-$NH_2$.

Aside from the twenty standard amino acids, there are a vast number of "nonstandard amino acids" or unnatural amino acids that are known to the art and that may be incorporated in the compounds described herein, as described above. Other nonstandard amino acids are modified with reactive side chains for conjugation (Gauthier, M. A. and Klok, H. A. (2008) Chem Commun (Camb) 2591-2611; de Graaf, A. J., et al. (2009) Bioconjug Chem 20: 1281-1295). In one approach, an evolved tRNA/tRNA synthetase pair and is coded in the expression plasmid by the amber suppressor codon (Deiters, A, et al. (2004). Bio-org. Med. Chem. Lett. 14, 5743-5). For example, p-azidophenylalanine was incorporated into peptides and then reacted with a functionalized surfactant, or a PEG polymer having an acetylene moiety in the presence of a reducing agent and copper ions to facilitate an organic reaction known as "Huisgen [3+2] cycloaddition." A similar reaction sequence using the reagents described herein containing an acetylene modified alkyl glycoside or PEG modified glycoside will result in PEGylated or alkyl glycoside modified peptides. For peptides of less than about 50 residues, standard solid phase synthesis is used for incorporation of said reactive amino acid residues at the desired position in the chain. Such surfactant-modified peptides and/or proteins offer a different spectrum of pharmacological and medicinal properties than peptides modified by PEG incorporation alone.

The skilled artisan will appreciate that numerous permutations of the peptide analogs are possible and, provided that an amino acid sequence has an incorporated surfactant moiety, will possess the desirable attributes of surfactant modified peptide products described herein.

Certain Definitions

As used in the specification, "a" or "an" means one or more. As used in the claim(s), when used in conjunction with the word "comprising," the words "a" or "an" mean one or more. As used herein, "another" means at least a second or more.

As used herein, the one- and three-letter abbreviations for the various common amino acids are as recommended in Pure Appl. Chem. 31, 639-645 (1972) and 40, 277-290 (1974) and comply with 37 CFR § 1.822 (55 FR 18245, May 1, 1990). The abbreviations represent L-amino acids unless otherwise designated as D- or DL. Certain amino acids, both natural and non-natural, are achiral, e.g., glycine, α-aminoisobutyric acid (Aib). All peptide sequences are presented with the N-terminal amino acid on the left and the C-terminal amino acid on the right.

An "alkyl" group refers to an aliphatic hydrocarbon group. Reference to an alkyl group includes "saturated alkyl" and/or "unsaturated alkyl", i.e., an alkene or an alkyne. The alkyl group, whether saturated or unsaturated, includes branched, straight chain, or cyclic groups. An alkyl group is optionally substituted with substituents including and not limited to oxo, halogen, aryl, cycloalkyl, hydrophobic natural product such as a steroid, an aralkyl chain (including alkoxyaryl), alkyl chain containing an acyl moiety, or the like. In some embodiments, an alkyl group is linked to the Nα-position of a residue (e.g., Tyr or Dmt) in a peptide. This class is referred to as N-alkyl and comprises straight or branched alkyl groups from $C_1$-$C_{10}$, or an aryl substituted alkyl group such as benzyl, phenylethyl and the like. In some embodiments, an alkyl moiety is a 1-alkyl group that is in glycosidic linkage (typically to the 1-position of, for example, glucose) to the saccharide moiety. Such a 1-alkyl group is a $C_1$-$C_{30}$ alkyl group.

An "aryl" group refers to an aromatic ring wherein each of the atoms forming the ring is a carbon atom. Aryl rings described herein include rings having five, six, seven, eight, nine, or more than nine carbon atoms. Aryl groups are optionally substituted with substituents selected from halogen, alkyl, acyl, alkoxy, alkylthio, sulfonyl, dialkyl-amino, carboxyl esters, cyano or the like. Examples of aryl groups include, but are not limited to phenyl, and naphthalenyl.

The term "acyl" refers to a $C_1$-$C_{20}$ acyl chain. This chain may comprise a linear aliphatic chain, a branched aliphatic chain, a chain containing a cyclic alkyl moiety, a hydrophobic natural product such as a steroid, an aralkyl chain, or an alkyl chain containing an acyl moiety.

The term "steroid nucleus" refers to the core of steroids comprising an arrangement of four fused rings designated A, B, C and D as shown below:

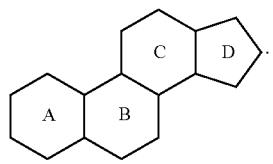

Examples of steroid nucleus containing moieties include, and are not limited to, cholesterol and the like.

As used herein, a "therapeutic composition" can comprise an admixture with an aqueous or organic carrier or excipient, and can be compounded, for example, with the usual nontoxic, pharmaceutically acceptable carriers for tablets, pellets, capsules, lyophilizates, suppositories, solutions, emulsions, suspensions, or other form suitable for use. The carriers, in addition to those disclosed above, can include alginate, collagen, glucose, lactose, mannose, gum acacia, gelatin, mannitol, starch paste, magnesium trisilicate, talc, corn starch, keratin, colloidal silica, potato starch, urea, medium chain length triglycerides, dextrans, and other carriers suitable for use in manufacturing preparations, in solid, semisolid, or liquid form. In addition, auxiliary stabilizing, thickening or coloring agents can be used, for example a stabilizing dry agent such as triulose.

As used herein, a "pharmaceutically acceptable carrier" or "therapeutic effective carrier" is aqueous or nonaqueous (solid), for example alcoholic or oleaginous, or a mixture thereof, and can contain a surfactant, emollient, lubricant, stabilizer, dye, perfume, preservative, acid or base for adjustment of pH, a solvent, emulsifier, gelling agent, moisturizer, stabilizer, wetting agent, time release agent, humectant, or other component commonly included in a particular form of pharmaceutical composition. Pharmaceutically acceptable carriers are well known in the art and include, for example, aqueous solutions such as water or physiologically buffered saline or other solvents or vehicles such as glycols, glycerol, and oils such as olive oil or injectable organic esters. A pharmaceutically acceptable carrier can contain physiologically acceptable compounds that act, for example, to stabilize or to increase the absorption of specific inhibitor, for example, carbohydrates, such as glucose, sucrose or dextrans, antioxidants, such as ascorbic acid or glutathione, chelating agents, low molecular weight proteins or other stabilizers or excipients.

The pharmaceutical compositions can also contain other pharmaceutically acceptable auxiliary substances as required to approximate physiological conditions, such "substances" include, but are not limited to, pH adjusting and buffering agents, tonicity adjusting agents and the like, for example, sodium acetate, sodium lactate, sodium chloride, potassium chloride, calcium chloride, etc. Additionally, the peptide, or variant thereof, suspension may include lipid-protective agents which protect lipids against free-radical and lipid-peroxidative damages on storage. Lipophilic free-radical quenchers, such as alpha-tocopherol and water-soluble iron-specific chelators, such as ferrioxamine, are suitable.

As used herein, a "surfactant" is a surface active agent that modifies interfacial tension of water. Typically, surfactants have one lipophilic and one hydrophilic group or region in the molecule. Broadly, the group includes soaps, detergents, emulsifiers, dispersing and wetting agents, and several groups of antiseptics. More specifically, surfactants include stearyltriethanolamine, sodium lauryl sulfate, sodium taurocholate, laurylaminopropionic acid, lecithin, benzalkonium chloride, benzethonium chloride and glycerin monostearate; and hydrophilic polymers such as polyvinyl alcohol, polyvinylpyrrolidone, polyethyleneglycol (PEG), carboxymethylcellulose sodium, methylcellulose, hydroxymethylcellulose, hydroxyethylcellulose and hydroxypropylcellulose or alkyl glycosides. In some embodiments, a surfactant is a non-ionic surfactant (e.g., an alkyl glycoside surfactant). In some embodiments, a surfactant is an ionic surfactant.

As used herein, "alkyl glycoside" refers to any sugar joined by a linkage to any hydrophobic alkyl, as is known in the art. The hydrophobic alkyl can be chosen of any desired size, depending on the hydrophobicity desired and the hydrophilicity of the saccharide moiety. In one aspect, the range of alkyl chains is from 1 to 30 carbon atoms; or from 6 to 16 carbon atoms.

As used herein, "saccharide" is inclusive of monosaccharides, oligosaccharides or polysaccharides in straight chain or ring forms. Oligosaccharides are saccharides having two or more monosaccharide residues. Some examples of the many possible saccharides suitable for use in functionalized form include glucose, galactose, maltose, melibiose, maltotriose, maltotetraose, sucrose, trehalose or the like.

As used herein, "sucrose esters" are sucrose esters of fatty acids. Sucrose esters can take many forms because of the eight hydroxyl groups in sucrose available for reaction and the many fatty acid groups, from acetate on up to larger, more bulky fats that can be reacted with sucrose. This flexibility means that many products and functionalities can be tailored, based on the fatty acid moiety used. Sucrose esters have food and non-food uses, especially as surfactants and emulsifiers, with growing applications in pharmaceuticals, cosmetics, detergents and food additives. They are biodegradable, non-toxic and mild to the skin.

As used herein, a "suitable" alkyl glycoside means one that is nontoxic and nonionic. In some instances, a suitable alkyl glycoside reduces the immunogenicity or aggregation and increases the bioavailability of a compound when it is administered with the compound via the ocular, nasal, nasolacrimal, sublingual, buccal, inhalation routes or by injection routes such as the subcutaneous, intramuscular, or intravenous routes. Suitable compounds can be determined using the methods known to the art and those set forth in the examples.

A "linker amino acid" is any natural or unnatural amino acid that comprises a reactive functional group (de Graaf, A. J., et al. (2009) Bioconjug Chem 20: 1281-1295) that is used for covalent linkage with the functionalized surfactant. By way of example, in some embodiments, a linker amino acid is Lys, or Orn having a reactive functional group —NH$_2$; or Cys, having a reactive functional group —SH; or Asp or Glu, having a reactive functional group —C(=O)—OH. By way of example, in some other embodiments, a linker amino acid is any amino acid having a reactive functional group such as —OH, —N$_3$, haloacetyl or an acetylenic group that is used for formation of a covalent linkage with a suitably functionalized surfactant.

As used herein, a "functionalized surfactant" is a surfactant comprising a reactive group suitable for covalent linkage with a linker amino acid. By way of example, in some embodiments, a functionalized surfactant comprises a carboxylic acid group (e.g., at the 6-position of a monosaccharide) as the reactive group suitable for covalent linkage with a linker amino acid. By way of example, in some embodiments, a functionalized surfactant comprises a —NH$_2$ group, a —N$_3$ group, an acetylenic group, a haloacetyl group, a —O—NH$_2$ group, or a —(CH$_2$—)m-maleimide group, e.g., at the 6-position of a monosaccharide (as shown in Scheme 6), that allows for covalent linkage with a suitable linker amino acid. In some embodiments, a functionalized surfactant is a compound of Formula IV as described herein.

As used herein, the term "peptide" is any peptide comprising two or more amino acids. The term peptide includes short peptides (e.g., peptides comprising between 2-14 amino acids), medium length peptides (15-50) or long chain peptides (e.g., proteins). The terms peptide, medium length peptide and protein may be used interchangeably herein. As used herein, the term "peptide" is interpreted to mean a polymer composed of amino acid residues, related naturally occurring structural variants, and synthetic non-naturally occurring analogs thereof linked via peptide bonds, related naturally occurring structural variants, and synthetic non-naturally occurring analogs thereof. Synthetic peptides can be synthesized, for example, using an automated peptide synthesizer.

Peptides may contain amino acids other than the 20 gene encoded amino acids. "Peptide(s)" include those modified either by natural processes, such as processing and other post-translational modifications, but also by chemical modification techniques. Such modifications are well described in basic texts and in more detailed monographs, and are well-known to those of skill in the art. It will be appreciated that in some embodiments, the same type of modification is present in the same or varying degree at several sites in a given peptide. Also, a given peptide, in some embodiments, contains more than one type of modifications. Modifications occur anywhere in a peptide, including the peptide backbone, the amino acid side-chains, and the amino or carboxyl termini.

Accordingly, also contemplated within the scope of embodiments described herein are surfactants covalently attached to peptides that are modified, including, for example, modification by, acetylation, acylation, PEGylation, ADP-ribosylation, amidation, covalent attachment of a lipid or lipid derivative, covalent attachment of phosphotidylinositol, cross-linking, cyclization, disulfide bond formation, demethylation, formation of covalent cross-link formation of cysteine, formation of pyroglutamate, formylation, gamma-carboxylation, glycosylation, GPI anchor formation, hydroxylation, iodination, methylation, myristoylation, oxidation, proteolytic processing, phosphorylation, prenylation, racemization, glycosylation, lipid attachment, sulfation, gamma-carboxylation of glutamic acid residues, hydroxylation and ADP-ribosylation, selenoylation, sulfation, transfer-RNA mediated addition of amino acids to proteins, such as arginylation, and ubiquitination. See, for instance, (Nestor, J. J., Jr. (2007) Comprehensive Medicinal Chemistry II 2: 573-601, Nestor, J. J., Jr. (2009) Current Medicinal Chemistry 16: 4399-4418, Creighton, T. E. (1993, Wold, F. (1983) Posttranslational Covalent Modification of Proteins 1-12, Seifter, S. and Englard, S. (1990) Methods Enzymol 182: 626-646, Rattan, S. I., et al. (1992) Ann N Y Acad Sci 663: 48-62). Also contemplated within the scope of embodiments described herein are peptides that are branched or cyclic, with or without branching. Cyclic, branched and branched circular peptides result from post-translational natural processes and are also made by suitable synthetic methods.

The term peptide includes peptides or proteins that comprise natural and unnatural amino acids or analogs of natural amino acids. As used herein, peptide and/or protein "analogs" comprise non-natural amino acids based on natural amino acids, such as tyrosine analogs, which includes para-substituted tyrosines, ortho-substituted tyrosines, and meta substituted tyrosines, wherein the substituent on the tyrosine comprises an acetyl group, a benzoyl group, an amino group, a hydrazine, an hydroxyamine, a thiol group, a carboxy group, a methyl group, an isopropyl group, a $C_2$-$C_{20}$ straight chain or branched hydrocarbon, a saturated or unsaturated hydrocarbon, an O-methyl group, a polyether group, a halogen, a nitro group, or the like. Examples of Tyr analogs include 2,4-dimethyl-tyrosine (Dmt), 2,4-diethyl-tyrosine, O-4-allyl-tyrosine, 4-propyl-tyrosine, Cα-methyl-tyrosine and the like. Examples of lysine analogs include ornithine (Orn), homo-lysine, Cα-methyl-lysine (CMeLys), and the like. Examples of phenylalanine analogs include, but are not limited to, meta-substituted phenylalanines, wherein the substituent comprises a methoxy group, a $C_1$-$C_{20}$ alkyl group, for example a methyl group, an allyl group, an acetyl group, or the like. Specific examples include, but are not limited to, 2,4,6-trimethyl-L-phenylalanine (Tmp), O-methyl-tyrosine, 3-(2-naphthyl)alanine (Nal(2)), 3-(1-naphthyl)alanine (Nal(1)), 3-methyl-phenylalanine, 1,2,3,4-tetrahydroisoquinoline-3-carboxylic acid (Tic), fluorinated phenylalanines, isopropyl-phenylalanine, p-azidophenylalanine, p-acyl-phenylalanine, p-benzoyl-phenylalanine, p-iodo-phenylalanine, p-bromophenylalanine, p-amino-phenylalanine, and isopropyl-phenylalanine, and the like. Among the vast array of nonstandard or unnatural amino acids known to the art and used in peptide analog design are C-alpha-disubstituted amino acids such as Aib, Ca-diethyl-glycine (Deg), aminocyclopentane-1-carboxylic acid (Ac4c), aminocyclopentane-1-carboxylic acid (Ac5c), and the like. Such amino acids frequently lead to a restrained structure, often biased toward an alpha helical structure (Kaul, R. and Balaram, P. (1999) Bioorg Med Chem 7: 105-117). Additional examples of such unnatural amino acids useful in analog design are homo-arginine (Har), and the like. Substitution of reduced amide bonds in certain instances leads to improved protection from enzymatic destruction or alters receptor binding. By way of example, incorporation of a Tic-Phe dipeptide unit with a reduced amide bond between the residues (designated as Tic-Ψ[CH2-NH]-Ψ-Phe) reduces enzymatic degradation. Accordingly, also contemplated within the scope of embodiments described herein are surfactants covalently attached to peptides that comprise modified amino acids and/or peptide analogs described above. Certain non-natural amino acids are shown below.

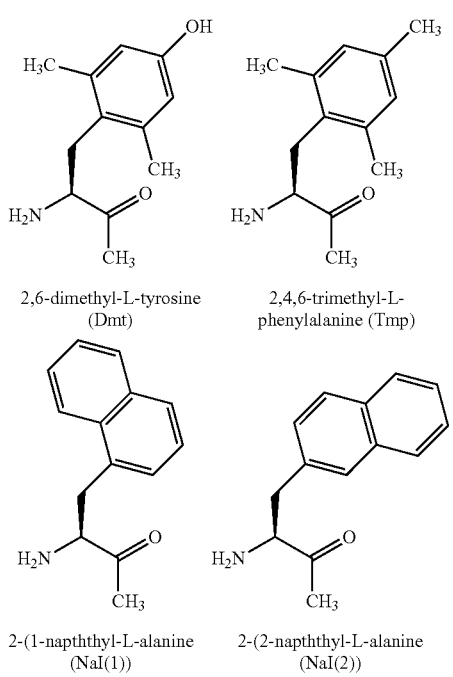

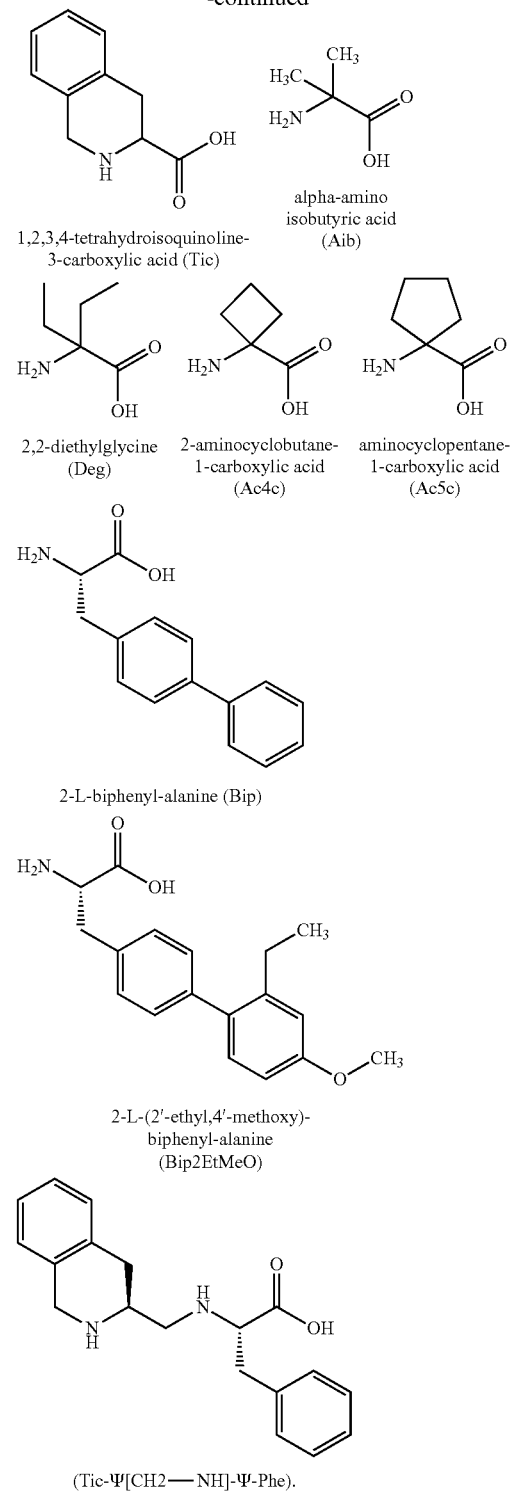

As used herein, "opioid peptides" are short sequences of amino acids that bind to opioid receptors in the body. In some embodiments, opioid peptides are endogenous peptides, such as, for example, endorphins, enkephalins, endomorphins, dermorphins or the like. In some embodiments, opioid peptides are derived from endogenous opioid peptides (e.g., pseudo-peptides, constrained peptides, alpha-methyl analogs, or the like). In some embodiments, opioid peptides are exogenous and/or synthetic and comprise modified amino acids and/or unnatural amino acids that mimic the effects of opioid peptides.

As used herein, the term "variant" is interpreted to mean a peptide that differs from a reference peptide, but retains essential properties. A typical variant of a peptide differs in amino acid sequence from another, reference peptide. Generally, differences are limited so that the sequences of the reference peptide and the variant are closely similar overall and, in many regions, identical. A variant and reference peptide may differ in amino acid sequence by one or more substitutions, additions, deletions in any combination. A substituted or inserted amino acid residue may or may not be one encoded by the genetic code. Non-naturally occurring variants of peptides may be made by mutagenesis techniques, by direct synthesis, and by other suitable recombinant methods.

Reference now will be made in detail to various embodiments and particular applications of the covalently modified peptides and/or proteins described herein. While the covalently modified peptides and/or proteins will be described in conjunction with the various embodiments and applications, it will be understood that such embodiments and applications are exemplary and are not intended to limit the scope of the embodiments described herein. In addition, throughout this disclosure various patents, patent applications, websites and publications are referenced, and unless otherwise indicated, each is incorporated by reference in for relevant disclosure referenced herein.

Peptides

There are many important roles played by peptides in the body and some commercial opportunities have been exploited (Nestor, J. J., Jr. (2009) Current Medicinal Chemistry 16: 4399-4418; Stevenson, C. L. (2009) Curr Pharm Biotechnol 10: 122-137). However even these recognized targets (Tyndall, J. D., et al. (2005) Chem Rev 105: 793-826) and products continue to suffer from deficiencies in duration of action and bioavailability. In some embodiments, the improved peptides described herein provide longer duration of action and/or bioavailability and/or therapeutic efficacy compared to currently available commercial products. Some illustrative examples of peptides that represent attractive commercial targets for analog design (agonists and antagonists) for clinical development include, for example, members of the Class B, G Protein-Coupled Receptor (GPCR) ligands and related peptides ("Secretin family"): Secretin, Parathyroid Hormone (PTH), Parathyroid Hormone-related Protein (PTHrP), Glucagon, Glucagon Like Protein-1 and -2 (GLP-1, GLP-2), Glucose-dependent Insulinotropic Peptide (GIP), Oxyntomodulin, Pituitary Adenylate Cyclase-Activating Peptide (PACAP), Vasoactive Intestinal Peptide (VIP), Amylin (and analogs such as pramlintide, devalintide, et al.), Calcitonin (and analogs such as salmon calcitonin, elcatonin, et al.), calcitonin gene-related peptide (CGRP), Adrenomedulin, Corticotrophin-Releasing Factor family (CRF, Xerecept; Urocortin), and the like, including synthetic analogs thereof which would be improved as clinical products through further modification by the methods described herein. Also contemplated within the scope of embodiments presented herein are Opioid peptide families; such peptides would benefit from the methods of peptide modification described herein to give increased duration of action and increased specificity. By way of example analogs of the endomorphin, dynorphin, enkephalin, dermorphin, casomorphin, et al. peptide families offer attractive therapeutic approaches to the treatment of pain, addiction, et al. Additional attractive peptide targets for modification to yield peptide products described herein are the hypothalamic hormones, for example gonadotrophin hormone-releasing hormone and its analogs (for example nafarelin, goserelin, triptorelin, leuprorelin, fertirelin, histrelin, buserelin, ganirelix, cetrorelix, degarelix, deslorelin and the like), adrenocorticotrophin, somatostatin (for example octreotide, lanreotide, valpreotide et al.), thyrotropin-releasing hormone, growth hormone-releasing hormone, and neurotensin. A further example of attractive commercial targets are the pituitary hormones and analogs such as vasopressin (desmopressin, and the like), oxytocin and analogs, thyroid hormone stimulating hormone, prolactin, growth hormone, luteinizing hormone, follicular-stimulating hormone, alpha melanocyte-stimulating hormone analogs (melanotan analogs), and the like, as well as their analogs. Growth factors are an important class of molecules that may be advantageously modified using the methods described herein to yield improved pharmaceutical candidates, for example insulin (and analogs such as Lispro, Levemir, glargin, et al.), insulin-like growth factor-I (IGF-I or Somatomedin-C), Nerve Growth Factor (NGF), Fibroblast Growth Factor (FGF; FGF-18, FGF-20, FGF-21, and the like), Keratinocyte Growth Factor (KGF) and Vascular Endothelial Growth Factor (VEGF), and the like. Especially attractive targets are those peptides which control gut function and appetite, but which have short duration of action (some of which are mentioned above), including but not limited to, ghrelin, Pancreatic Peptide, Peptide YY, Neuropeptide Y, Cholecystokinin (Sincalide, et al.), Melanocortin, and the like. Additional targets benefiting from the methods described herein are the proinflammatory adipose tissue products relating to obesity, including Leptin (and related analogs such as OB-3 peptide), adipokines, adiponectin, Chemerin, visfatin, nesfatin, resistin, tumor necrosis factor alpha, chemokines, monocyte chemotactic protein-1 (MCP-1), omentin, interleukins, and the like. Important targets that would benefit from improved pharmaceutical and pharmacodynamic behavior are proteins that control immune function, among which are given the following examples, which are not meant to be limiting, merely illustrative: members of the interferon family (interferons-alpha, -beta, -gamma, -kappa, -omega, the IL-10 cytokine family, including IL-10, IL-19, IL-20, IL-22, IL-24, IL-26, and the like), Thymopentin, Thymosin alpha1, and the like. Important peptide products which control the circulatory, or blood clotting would be improved by the methods described herein whereby increased duration of action would be achieved, for example, bivalirudin (Angiomax), eptifibatide (Integrelin), atrial natriuretic peptides (ANP, Ularitide), brain natriuretic peptide, c type natriuretic peptide, b-type natriuretic peptide (nesiritide), angiotensin, Angiostatin, Rotigaptide, thrombospondins and the like. Peptides that stimulate stem cell proliferation and differentiation are important agents that could be improved by the modifications described herein. For example, erythropoietin, hematide, thrombopoietin, macrophage colony-stimulating factor (M-CSF), leukemia inhibitory factor (LIF), interleukin-6 (IL-6)), granulocyte colony-stimulating factor (G-CSF), granulocyte-macrophage-colony-stimulating factor (GM-CSF), and the like are contemplated as peptides that are suitable for covalent attachment to a surfactant (e.g., an alkyl glycoside surfactant). Neurotrophic factors are another class of small proteins that would greatly benefit from modifications described herein to increase duration of action and efficacy. For example, Glial cell-derived neurotrophic factor (GDNF) and family (neurturin, artemin, persephin), neurotrophins such as nerve growth factor (NGF), BDNF and the like. Proinflammatory and pain-causing peptides are important peptide targets that would be improved by modifications described herein. For example, inhibitors of bradykinin (or its release, e.g. ecallantide) and substance P especially antagonists, offer important therapeutic targets (icatibant, et al.) are suitable for covalent attachment of surfactants (e.g. alkyl-glycoside surfactants) Inhibitors of viral fusion (Fuzeon), protein maturation (protease inhibitors) or integration suffer from short duration of action. Modification of such inhibitors via covalent attachment of a surfactant (e.g., an alkyl-glycoside surfactant) will allow for longer duration of action. Many proteases have been found to be involved in disease and inhibitors of their action have reached the clinic (Abbenante, G. and Fairlie, D. P. (2005) Med Chem 1: 71-104), but would be further improved by the modifications described herein and such targets are also contemplated within the scope of the embodiments described herein. Additional natural peptide products and analogs thereof such as conotoxin peptides for pain, antimicrobial defensins and the like also suffer from lack of bioavailability and short duration of action in physiological fluid and therefore would benefit from the peptide modifications described herein. Those skilled in the art will recognize many additional commercially important peptides that are amenable to modifications described herein and provide increased duration of action and bioavailability, and such peptides are also contemplated within the scope of the present disclosure.

Modifications at the amino or carboxyl terminus may optionally be introduced into the present peptides (Nestor, J. J., Jr. (2009) Current Medicinal Chemistry 16: 4399-4418). For example, the present peptides can be truncated or acylated on the N-terminus to yield peptides exhibiting low efficacy, partial agonist and antagonist activity, as has been seen for some peptides (Gourlet, P., et al. (1998) Eur J Pharmacol 354: 105-111, Gozes, I. and Furman, S. (2003) Curr Pharm Des 9: 483-494), the contents of which is incorporated herein by reference). Other modifications to the N-terminus of peptides, such as deletions or incorporation of D-amino acids such as D-Phe also can give potent and long acting agonists or antagonists when substituted with the modifications described herein such as long chain alkyl glycosides. Such agonists and antagonists also have commercial utility and are within the scope of contemplated embodiments described herein.

Aside from the twenty standard amino acids, there are a vast number of "nonstandard amino acids" or unnatural amino acids that are known to the art and that may be incorporated in the compounds described herein, as described above. Other nonstandard amino acids are modified with reactive side chains for conjugation (Gauthier, M. A. and Klok, H. A. (2008) Chem Commun (Camb) 2591-2611; de Graaf, A. J., et al. (2009) Bioconjug Chem 20: 1281-1295). In one approach, an evolved tRNA/tRNA synthetase pair and is coded in the expression plasmid by the amber suppressor codon (Deiters, A, et al. (2004). Bio-org. Med. Chem. Lett. 14, 5743-5). For example, p-azidophenylalanine was incorporated into peptides and then reacted with a functionalized surfactant, or a PEG polymer having an acetylene moiety in the presence of a reducing agent and copper ions to facilitate an organic reaction known as "Huisgen [3+2] cycloaddition." A similar reaction sequence using the reagents described herein containing an acetylene modified alkyl glycoside or PEG modified glycoside will result in PEGylated or alkyl glycoside modified peptides. For peptides of less than about 50 residues, standard solid phase synthesis is used for incorporation of said reactive amino acid residues at the desired position in the chain. Such surfactant-modified peptides and/or proteins offer a different spectrum of pharmacological and medicinal properties than peptides modified by PEG incorporation alone.

Intermediates

In one embodiment provided herein are intermediates and/or reagents comprising a surfactant moiety and a reactive functional group capable of forming a bond with a reactive functional group on a natural or unnatural amino acid. These intermediates and/or reagents allow for improvement in the bioavailability and pharmaceutical, pharmacokinetic and/or pharmacodynamic behavior of peptides and/or proteins of use in human and animal disease. Covalent attachment of such intermediates and/or reagents via a functional group on a side chain of an amino acid, for example on an epsilon-amino function of Lys, the sulfhydryl of Cys, or at the amino or carboxy terminus of the peptide and/or protein target allows for synthesis of the peptide products described herein. In specific embodiments, non-ionic surfactant moieties are mono or disaccharides with an O-alkyl glycosidic substitution, said glycosidic linkage being of the alpha or beta configuration. In specific embodiments, O-alkyl chains are from $C_1$-$C_{20}$ or from $C_6$-$C_{16}$ alkyl chains.

In another embodiment provided herein are intermediates and/or reagents comprising a non-ionic surfactant moiety with certain alkyl glycosidic linkage that mimic O-alkyl glycosidic linkages and a reactive functional group capable of forming a bond with a reactive functional group on a natural or unnatural amino acid. Such intermediates and/or reagents contain S-linked alkyl chains or N-linked alkyl chains and have altered chemical and/or enzymatic stability compared to the O-linked alkyl glycoside-linked products.

In some embodiments, an intermediate and/or reagent provided herein is a compound wherein the hydrophilic group is a modified glucose, galactose, maltose, glucuronic acid, diglucuronic acid, maltouronic acid or the like. In some embodiments, the hydrophilic group is glucose, maltose, glucuronic acid, diglucuronic acid or maltouronic acid and the hydrophobic group is a $C_1$-$C_{20}$ alkyl chain or an aralkyl chain. In some embodiments the glycosidic linkage to the hydrophobic group is of an alpha configuration and in some the linkage is beta at the anomeric center on the saccharide.

In some embodiments, the hydrophilic group is glucose, maltose, glucuronic acid, diglucuronic acid or maltouronic acid and the hydrophobic group is a $C_1$-$C_{20}$ alkyl or aralkyl chain.

In some embodiments, an intermediate and/or reagent provided herein comprises a surfactant containing a reactive functional group that is a carboxylic acid group, an amino group, an azide, an aldehyde, a maleimide, a sulfhydryl, a hydroxylamino group, an alkyne or the like.

In some embodiments, the intermediate and/or reagent is an O-linked alkyl glycoside with one of the hydroxyl functions modified to be a carboxylic acid or amino functional group. In some embodiments, the reagent is a 1-O-alkyl glucuronic acid of alpha or beta configuration and the alkyl chain is from $C_1$ to $C_{20}$ in length. In some of such embodiments, the alkyl group is from $C_6$ to $C_{18}$ in length. In some of such embodiments, the alkyl group is from $C_6$ to $C_{16}$ in length.

In some embodiments, the reagent comprises a 1-O-alkyl diglucuronic acid of alpha or beta configuration and the alkyl chain is from $C_1$ to $C_{20}$ in length. In some of such embodiments, the alkyl group is from $C_6$ to $C_{16}$ in length.

In some embodiments, the reagent is an S-linked alkyl glycoside of alpha or beta configuration with one of the hydroxyl functions modified to be a carboxylic acid or amino functional group.

In some embodiments, the reagent is an N-linked alkyl glycoside of alpha or beta configuration with one of the hydroxyl functions modified to be a carboxylic acid or amino functional group.

In yet another embodiment provided herein are peptide and/or protein products containing a covalently linked alkyl glycoside with properties acceptable for use in human and animal disease. Scheme 1 lists exemplary non-ionic surfactants that can be modified to yield the reagents and/or intermediates that are useful for synthesis of surfactant-modified peptide products described herein.

moselective methods for oxidation of the primary alcohol at the 6 position of alkyl glucosides are available. For example, use of catalytic amounts of 2,2,6,6-tetramethyl-1-piperidinyloxyl (TEMPO) with stoichiometric amounts of the organic oxidant [bis(acetoxy)iodo]benzene (BAIB) (De Mico, A., et al. (1997) J Org Chem 1997: 6974-6977) gave outstanding yields of nucleoside-5'-carboxylic acids (Epp, J. B. and Widlanski, T. S. (1999) J Org Chem 64: 293-295) by oxidation of the primary hydroxyl. This oxidation is chemoselective for the primary hydroxyl even when the other, secondary hydroxyls are unprotected (Codee, J. D., et al.

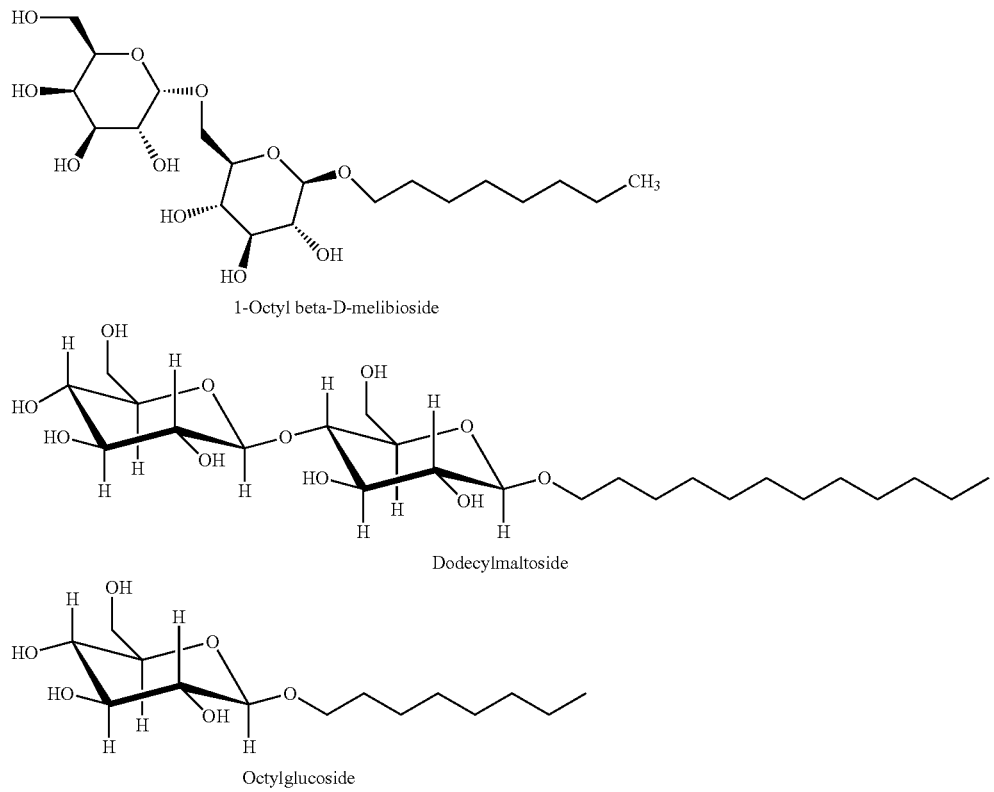

Scheme 1. Examples of commerically-available non-ionic surfactants of the alkyl glycoside class 1-Octyl beta-D-melibioside Dodecylmaltoside Octylglucoside In some embodiments, the covalently modified peptides and/or proteins described herein incorporate a surfactant moiety into the peptide structure. In specific embodiments, the covalently modified peptides and/or proteins described herein incorporate a non-ionic surfactant of the alkyl, alkoxyaryl, or aralkyl glycoside class. Alkyl glycosides, for example in the mono and disaccharide classes, are important commodities and are widely used in the food, service and cleaning industries. Thus their production on commercially significant scale has been the subject of extensive study. Both enzymatic and chemical processes are available for their production at very low cost (Park, D. W., et al. (2000) Biotechnology Letters 22: 951-956). These alkyl glycosides can be modified further to generate the intermediates for the synthesis of the covalently modified peptides and/or proteins described herein. Thus it is known that 1-dodecyl beta-D-glucoside is preferentially oxidized on the 6-position to yield the corresponding glucuronic acid analog in high yield when using the unprotected material and platinum black catalyst in the presence of oxygen (van Bekkum, H. (1990) Carbohydrates as Organic Raw Materials 289-310). Additional che- (2005) J Am Chem Soc 127: 3767-3773). In a similar manner, 1-dodecyl β-D-glucopyranoside and 1-tetradecyl β-D-glucopyranoside were oxidized to the corresponding uronic acids (1-dodecyl β-D-glucuronic acid, 1-tetradecyl β-D-glucuronic acid) by oxidation with TEMPO using KBr and sodium hypochlorite as stoichiometric oxidant (Milkereit, G., et al. (2004) Chem Phys Lipids 127: 47-63) in water. A mild oxidation procedure using (diacetoxyiodo)benzene (DAIB aka BAIB) is given in the Examples. Certain of these glucuronic acid intermediates are commercially available (for example octyl b-D-glucuronic acid; Carbosynth, MO 07928) and, as indicated, a broad range are subject to preparation by routine methods (Schamann, M. and Schafer, H. J. (2003) Eur J Org Chem 351-358; Van den Bos, L. J., et al. (2007) Eur J Org Chem 3963-3976) or upon request. Scheme 2 illustrates, as examples, certain functionalized surfactant intermediates comprising a —COOH group as a reactive functional group that are used to prepare the intermediates and/or reagents described herein.

Scheme 2. Examples of alkyl melibiouronic, diglucuronic and glucuronic acid class reagents.

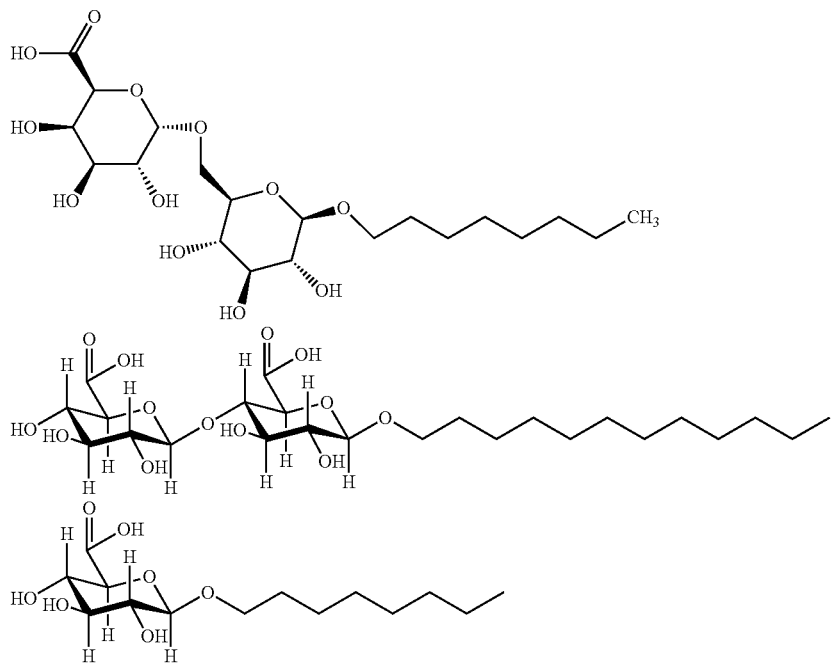

Similarly, aralkyl glycosides (including alkoxyaryl) can form the basis for closely related nonionic surfactant reagents. For example, 4-alkoxyphenyl β-D-glucopyranosides are readily synthesized by the reaction of 4-alkyloxyphenols with penta-O-acetyl β-D-glucose in the presence of boron trifluoride etherate. Subsequent deacetylation using trimethylamine in methanol/water and selective oxidation as described above and in the examples, yields the alkoxyaryl glucuronic acid reagents suitable for forming the reagents and peptides described herein ((Smits, E., et al. (1996) J Chem Soc, Perkin Trans I 2873-2877; Smits, E., et al. (1997) Liquid Crystals 23: 481-488).

Scheme 3. Illustrative members of aralkyl or alkoxyaryl surfactant moiety.

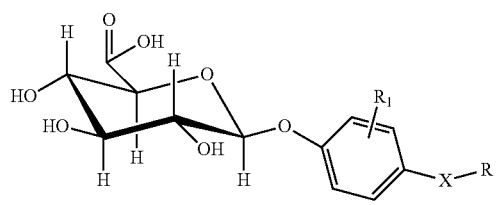

-continued

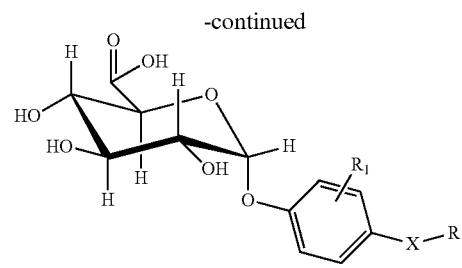

X = O, S, N, $CH_2$, NHCO, and the like

The glucuronic acid class of intermediate is readily activated by standard coupling agents for linkage to an amino acid side chain, e.g. that of Lys. Thus Fmoc-Lys-O-Tms (trimethylsilyl=TMS) can be reacted with octyl beta-D-glucuronic acid in the presence of a coupling agent and the O-Tms protecting group can then be hydrolyzed on aqueous workup to yield Fmoc-Lys(1-octyl beta-D-glucuronamide) as shown in Scheme 4. This reagent can be used for incorporation into the solid phase synthesis of peptides, using standard coupling protocols, when it is desired to incorporate the surfactant moiety near the N-terminal region of the molecule. The secondary hydroxyl groups can be left unprotected, due to the very much higher reactivity of the Lys amino functional group or they can be protected by peracetylation. If an acetyl protected form is used, the acetyl protecting groups can be removed in high yield by treatment with either MeOH/NaOMe or by MeOH/$Et_3$N. Scheme 4 illustrates preparation of the reagents described herein.

Scheme 4. Example of a preparation of a reagent

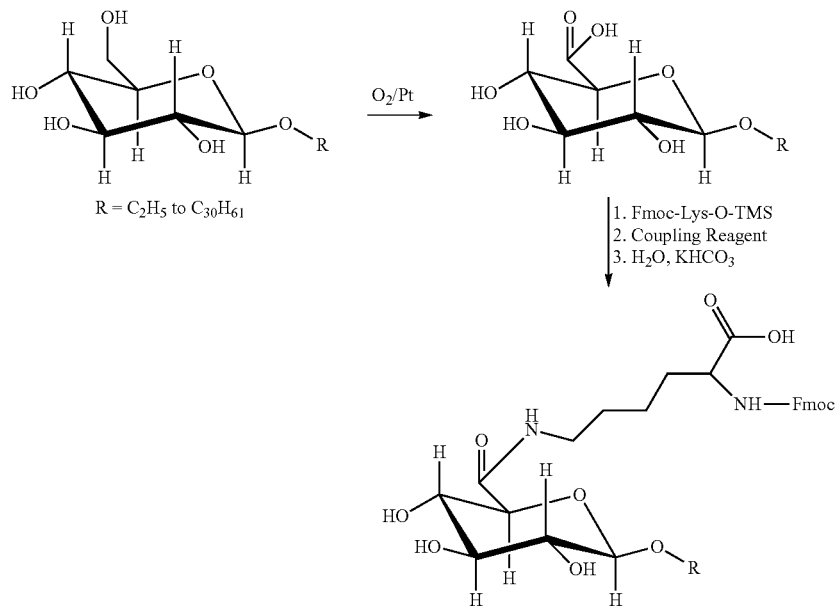

In some embodiments, reagents and/or intermediates for the preparation of the biologically active peptide products described herein comprise a family of surfactant-modified linker amino acids for incorporation into synthetic peptide products. Thus in one embodiment, peptide products described herein are synthesized in a linear fashion wherein a functionalized surfactant is attached to a reversibly-protected linker amino acid via a functional group on a side chain of a linker amino acid (e.g., an amino group of a lysine residue) to yield a proprietary reagent (as shown in Scheme 4) which can be incorporated into the growing peptide chain and then the remaining peptide is synthesized by attachment of further amino acids to the cysteine residue. Protecting group suitable for synthesis of modified peptides and/or protein described herein are described in, for example, T. W. Green, P. G. M. Wuts, Protective Groups in Organic Synthesis, Wiley-Interscience, New York, 1999, 503-507, 736-739, which disclosure is incorporated herein by reference.

In another embodiment, peptide products described herein are synthesized by covalent attachment of a functionalized surfactant to a full-length peptide via a suitable functional group on a linker amino acid that is in the peptide chain.

Alternatively a functionalized surfactant can be added to a linker amino acid side chain which has been deprotected during the course of the solid phase synthesis of the peptide. As an example, an alkyl glucuronyl group can be added directly to a linker amino acid side chain (e.g., a deprotected Lys side chain) during the solid phase synthesis of the peptide. For example, use of Fmoc-Lys(Alloc)-OH as a subunit provides orthogonal protection that can be removed while the peptide is still on the resin. Thus deprotection of the Lys side chain using Pd/thiobarbital, Pd/1,3-dimethyl barbituric acid (DMBA) or other alloc deprotection recipe allows exposure of the amino group for coupling with the acyl protected or unprotected 1-octyl beta-D-glucuronic acid unit or for side chain lactam formation. Final deprotection with a low % $CF_3CO_2H$ (TFA) cleavage cocktail will then deliver the desired product. Although the glycosidic linkage is labile to strong acid, the experience here and by others is that it is relatively stable to low % TFA cleavage conditions. Alternatively, acyl protection (e.g. acetyl, Ac; benzoyl, Bz) or trialkylsilyl protection on the saccharide OH functional groups may be used to provide increased protection to the glycosidic linkage. Subsequent deprotection by base ($NH_2NH_2$/MeOH; $NH_3$/MeOH, NaOMe/MeOH) yields the desired deprotected product. Scheme 4 illustrates reagents described herein. Scheme 5 illustrates peptide intermediates described herein.

Scheme 5. Ilustrative example of a peptide intermediate.

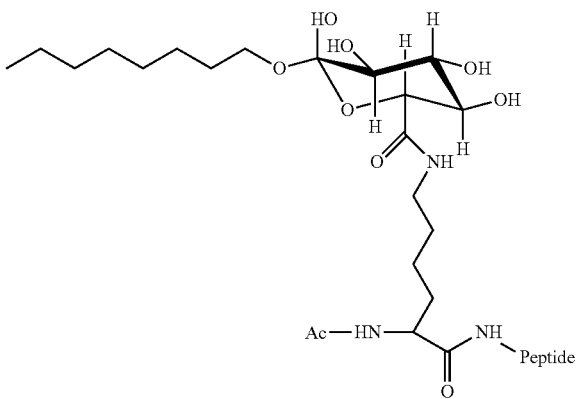

Additional reagents are generated by modification of the 6-position functional group to give varied means of linkage to amino acid side chain functional groups, as shown below in Scheme 6. Thus amino substitution can be used for linkage to Asp or Glu side chains. Azido or alkyne substitution can be used for linkage to unnatural amino acids containing the complementary acceptor for Huisgen 3+2 cycloaddition (Gauthier, M. A. and Klok, H. A. (2008) Chem Commun (Camb) 2591-2611). Aminoxy or aldehyde functional groups can be used to link to aldehyde (i.e. oxime linkage) or to amino functions (i.e. reductive alkylation), respectively. The maleimide or —NH—(C=O)—CH₂—Br functional group can bind chemoselectively with a Cys or other SH functional group. These types of linkage strategies are advantageous when used in conjunction with the reagents described herein. Interconversion of functional groups is widely practiced in organic synthesis and comprehensive lists of multiple routes to each of the functional group modifications listed herein are available (Larock, R. C. (1999)) "Comprehensive Organic Transformations", VCH Publishers, New York.

Thus, for example, the primary hydroxyl on position 6 of octyl 1-β-D-glucoside is converted to the azide by activation and displacement with an azide anion, reactions such as reactions used in carbohydrate chemistry (e.g. by tosylation followed by NaN₃). The corresponding azide is reduced to the amino function by reduction with thiolacetic acid in pyridine (Elofsson, M., et al. (1997) Tetrahedron 53: 369-390) or by similar methods of amino group generation (Stangier, P., et al. (1994) Liquid Crystals 17: 589-595). Approaches to the acetylene, aminoxy, and aldehyde moieties are best carried out on the triacetoxy form, available from the commercially available glucoside by treatment with Ac₂O, followed by mild hydrolysis of the primary amine. This 6-hydroxy form can be selectively oxidized to the aldehyde, or activated as a tosylate or triflate and displaced by NH₂OH or by sodium acetylide. The maleimide linkage can be through a carbon linkage as shown or, preferably though an O or amide linkage, again by displacement of the activated hydroxyl or coupling of the glucuronic acid derivative to an amino linked maleimide reagent, well known in the art. Additional functional group interconversions are well known to those of average skill in the art of medicinal chemistry and are within the scope of the embodiments described herein.

Also contemplated within the scope of synthetic methods described herein are surfactants wherein the saccharide and hydrophobic chain are covalently attached via an alpha glycosidic linkage. Synthetic routes to predominantly α-linked glycosides are well known in the art and typically originate with the peracetyl sugar and use acidic catalysis (e.g. SnCl₄, BF₃ or HCl) to effect the α-glycosylation (Cudic, M. and Burstein, G. D. (2008) Methods Mol Biol 494: 187-208, Vill, V., et al. (2000) Chem Phys Lipids 104: 75-91, incorporated herein by reference for such disclosure). Similar synthetic routes exist for disaccharide glycosides (von Minden, H. M., et al. (2000) Chem Phys Lipids 106: 157-179, incorporated herein by reference for such disclosure). Functional group interconversions then proceed as above to lead to the 6-carboxylic acid, et al. for generation of the corresponding α-linked reagents.

Scheme 6 lists certain compounds and reagents useful in the synthesis of the covalently modified peptides and/or proteins described herein. Standard nomenclature using single letter abbreviations for amino acids are used.

Scheme 6. Additional reagent examples.

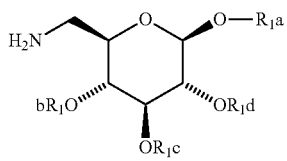

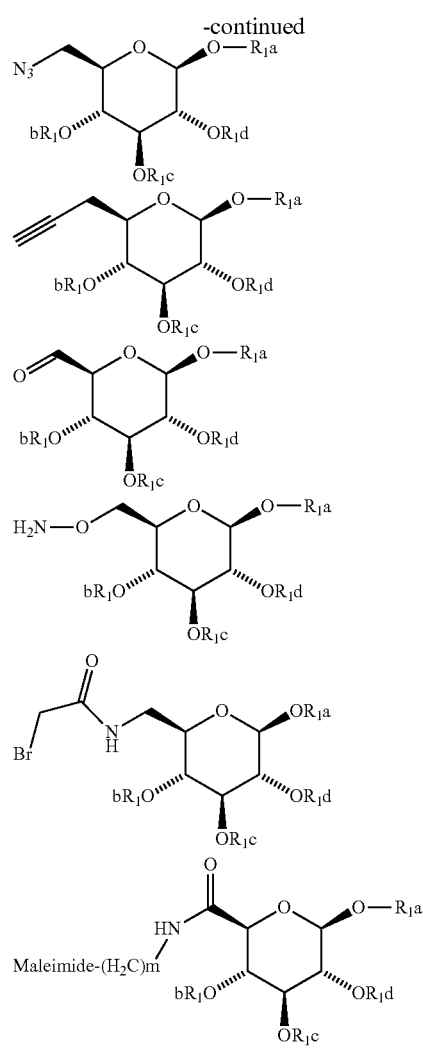

R1a = C1-C30
R1b-d = H, Ac, Bz, Bn, OMe

Many alkyl glycosides can be synthesized by known procedures, as described, e.g., in (Rosevear, P., et al. (1980) Biochemistry 19: 4108-4115, Li, Y. T., et al. (1991) J Biol Chem 266: 10723-10726) or Koeltzow and Urfer, J. Am. Oil Chem. Soc., 61:1651-1655 (1984), U.S. Pat. No. 3,219,656 and U.S. Pat. No. 3,839,318 or enzymatically, as described, e.g., in (Li, Y. T., et al. (1991) J Biol Chem 266: 10723-10726, Gopalan, V., et al. (1992) J Biol Chem 267: 9629-9638). O-alkyl linkages to natural amino acids such as Ser can be carried out on the Fmoc-Ser-OH using peracetylglucose to yield Nα-Fmoc-4-O-(2,3,4,6-tetra-O-acetyl-β-D-glucopyranosyl)-L-serine. This material is selectively deprotected at the primary carbon atom (position 6) and selectively oxidized using TEMPO/BAIB as described above to yield the corresponding 6-carboxyl function which may be coupled to lipophilic amines to generate a new class of nonionic surfactant and reagents (Scheme 7).

Scheme 7. Alternative example of nonionic surfactant reagent.

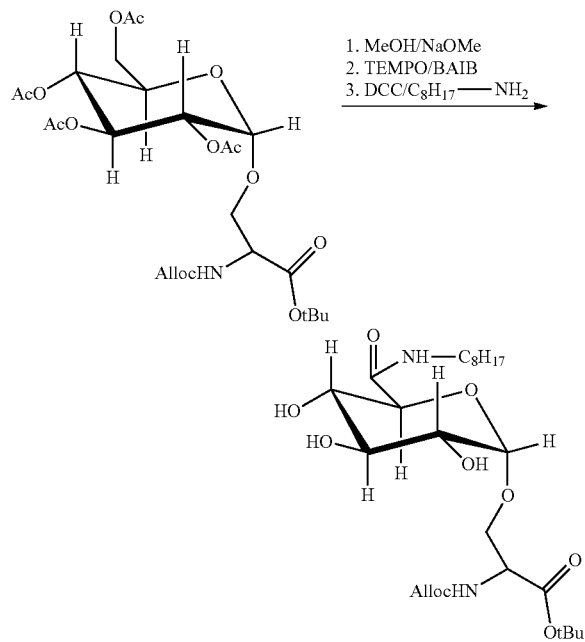

The linkage between the hydrophobic alkyl and the hydrophilic saccharide can include, among other possibilities, a glycosidic, thioglycosidic, amide (Carbohydrates as Organic Raw Materials, F. W. Lichtenthaler ed., VCH Publishers, New York, 1991), ureide (Austrian Pat. 386,414 (1988); Chem. Abstr. 110:137536p (1989); see Gruber, H. and Greber, G., "Reactive Sucrose Derivatives" in Carbohydrates as Organic Raw Materials, pp. 95-116) or ester linkage (Sugar Esters: Preparation and Application, J. C. Colbert ed., (Noyes Data Corp., New Jersey), (1974)).

Examples from which useful alkyl glycosides can be chosen for modification to the reagents or for the formulation of the products described herein, include: alkyl glycosides, such as octyl-, nonyl-, decyl-, undecyl-, dodecyl-, tridecyl-, tetradecyl, pentadecyl-, hexadecyl-, heptadecyl-, and octadecyl-D-maltoside, -glucoside or -sucroside (i.e., sucrose ester) (synthesized according to Koeltzow and Urfer; Anatrace Inc., Maumee, Ohio; Calbiochem, San Diego, Calif.; Fluka Chemie, Switzerland); alkyl thiomaltosides, such as heptyl, octyl, dodecyl-, tridecyl-, and tetradecyl-β-D-thiomaltoside (synthesized according to Defaye, J. and Pederson, C., "Hydrogen Fluoride, Solvent and Reagent for Carbohydrate Conversion Technology" in Carbohydrates as Organic Raw Materials, 247-265 (F. W. Lichtenthaler, ed.) VCH Publishers, New York (1991); Ferenci, T., J. Bacteriol, 144:7-11 (1980)); alkyl thioglucosides, such as 1-dodecyl- or 1-octyl-thio α- or β-D-glucopyranoside (Anatrace, Inc., Maumee, Ohio; see Saito, S. and Tsuchiya, T. Chem. Pharm. Bull. 33:503-508 (1985)); alkyl thiosucroses (synthesized according to, for example, Binder, T. P. and Robyt, J. F., Carbohydr. Res. 140:9-20 (1985)); alkyl maltotriosides (synthesized according to Koeltzow and Urfer); long chain aliphatic carbonic acid amides of sucrose amino-alkyl ethers; (synthesized according to Austrian Patent 382,381 (1987); Chem. Abstr., 108:114719 (1988) and Gruber and Greber pp. 95-116); derivatives of palatinose and isomaltamine linked by amide linkage to an alkyl chain (synthesized according to Kunz, M., "Sucrose-based Hydrophilic Building Blocks as Intermediates for the Synthesis of Surfactants and Polymers" in Carbohydrates as Organic Raw Materials, 127-153); derivatives of isomaltamine linked by urea to an alkyl chain (synthesized according to Kunz); long chain aliphatic carbonic acid ureides of sucrose amino-alkyl ethers (synthesized according to Gruber and Greber, pp. 95-116); and long chain aliphatic carbonic acid amides of sucrose amino-alkyl ethers (synthesized according to Austrian Patent 382,381 (1987), Chem. Abstr., 108:114719 (1988) and Gruber and Greber, pp. 95-116).

Some preferred glycosides include the saccharides maltose, sucrose, glucose and galactose linked by glycosidic or ester linkage to an alkyl chain of 6, 8, 10, 12, or 14 carbon atoms, e.g., hexyl-, octyl-, decyl-, dodecyl- and tetradecyl-maltoside, sucroside, glucoside and galactoside. In the body these glycosides are degraded to non-toxic alcohol or fatty acid and an oligosaccharide or saccharide. The above examples are illustrative of the types of alkyl glycosides to be used in the methods claimed herein, however the list is not intended to be exhaustive.

Generally, these surfactants (e.g., alkyl glycosides) are optionally designed or selected to modify the biological properties of the peptide, such as to modulate bioavailability, half-life, receptor selectivity, toxicity, biodistribution, solubility, stability, e.g. thermal, hydrolytic, oxidative, resistance to enzymatic degradation, and the like, facility for purification and processing, structural properties, spectroscopic properties, chemical and/or photochemical properties, catalytic activity, redox potential, ability to react with other molecules, e.g., covalently or noncovalently, and the like.

Surfactants

The term "surfactant" comes from shortening the phrase "surface active agent". In pharmaceutical applications, surfactants are useful in liquid pharmaceutical formulations in which they serve a number of purposes, acting as emulsifiers, solubilizers, and wetting agents. Emulsifiers stabilize the aqueous solutions of lipophilic or partially lipophilic substances. Solubilizers increase the solubility of components of pharmaceutical compositions increasing the concentration which can be achieved. A wetting agent is a chemical additive which reduces the surface tension of a fluid, inducing it to spread readily on a surface to which it is applied, thus causing even "wetting" of the surface with the fluids. Wetting agents provide a means for the liquid formulation to achieve intimate contact with the mucous membrane or other surface areas with which the pharmaceutical formulation comes in contact. Thus surfactants may be useful additives for stabilization of the formulation of the peptide products described herein as well as for the modification of the properties of the peptide itself.

In specific embodiments, alkyl glycosides which are synthetically accessible, e.g., the alkyl glycosides dodecyl, tridecyl and tetradecyl maltoside or glucoside as well as sucrose dodecanoate, tridecanoate, and tetradecanoate are suitable for covalent attachment to peptides as described herein. Similarly, the corresponding alkylthioglycosides are stable, synthetically accessible surfactants which are acceptable for formulation development.

A wide range of physical and surfactant properties can be achieved by appropriate modification of the hydrophobic or hydrophilic regions of the surfactant (e.g., the alkyl glycoside). For example, a study comparing the bilayer activity of dodecyl maltoside (DM) with that of dodecyl glucoside (DG) found that of DM to be more than three times higher than that of DG, despite having the same length of hydrophobic tail (Lopez, O., et al. (2002) Colloid Polym Sci 280: 352-357). In this particular instance the identity of the polar region (disaccharide vs monosaccharide) influences surfactant behavior. In the case of a surfactant linked to a peptide, e.g. the peptide products described herein, the peptide region also may contribute hydrophobic or hydrophilic character to the overall molecule. Thus tuning of the physical and surfactant properties may be used to achieve the particular physical and pharmaceutical properties suitable for the individual peptide targets.

PEG Modification

In some embodiments, surfactant-modified peptide products described herein are further modified to incorporate one or more PEG moieties (Veronese, F. M. and Mero, A. (2008) BioDrugs 22: 315-329). In some instances, incorporation of large PEG chains prevents filtration of the peptide in the glomeruli in the kidney into the dilute urine forming there (Nestor, J. J., Jr. (2009) Current Medicinal Chemistry 16: 4399-4418, Caliceti, P. and Veronese, F. M. (2003) Adv Drug Deliv Rev 55: 1261-1277). In some embodiments, an optional PEG hydrophilic chain allows for balancing the solubility and physical properties of the peptides or proteins that have been rendered hydrophobic by the incorporation of the longer chain alkyl glycoside moiety.

PEGylation of a protein can have potentially negative effects as well. It is widely recognized that PEGylation and other polymeric modifications can cause a substantial loss of biological activity for many proteins and this may relate to ligands for specific classes of receptors. In such instances there may be a benefit to reversible PEGylation (Peleg-Shulman, T., et al. (2004) J Med Chem 47: 4897-4904, Greenwald, R. B., et al. (2003) Adv Drug Deliv Rev 55: 217-250, Roberts, M. J. and Harris, J. M. (1998) J Pharm Sci 87: 1440-1445).

In addition, the increased molecular mass may prevent penetration of physiological barriers other than the glomerular membrane barrier. For example, it has been suggested that high molecular weight forms of PEGylation may prevent penetration to some tissues and thereby reduce therapeutic efficacy. In addition, high molecular weight may prevent uptake across mucosal membrane barriers (nasal, buccal, vaginal, oral, rectal, lung delivery). However delayed uptake may be highly advantageous for administration of stable molecules to the lung, substantially prolonging the duration of action. The peptide and/or protein products described herein have increased transmucosal bioavailability and this will allow longer chain PEG modifications to be used in conjunction with the surfactant modification with the achievement of commercially significant bioavailability following intranasal or other transmucosal route.

In some embodiments, long chain PEG polymers, and short chain PEG polymers are suitable for modification of the proteins and peptides described herein. Administration of treatments for diabetes by inhalation is a new approach for drug delivery and the lung has a highly permeable barrier (e.g. Exubera). For this application, delayed penetration of the lung barrier, preferred forms of PEGylation are in the lower molecular weight range of $C_{10}$ to $C_{400}$ (roughly 250 to 10,000 Da). Thus while a primary route to prolongation by PEG is the achievement of an "effective molecular weight" above the glomerular filtration cut-off (greater than 68 kDa), use of shorter chains may be a route for prolongation of residence in the lung for treatment of lung diseases and other respiratory conditions. Thus PEG chains of about 500 to 3000 Da are of sufficient size to slow the entry into the peripheral circulation, but insufficient to cause them to have a very prolonged circulation time. In some embodiments, PEGylation is applied to give increased local efficacy to the lung tissue with reduced potential for systemic side effects for the the covalently modified peptides and/or proteins described herein. In some of such embodiments, PEG chains in the range from about 750 to about 1500 Da are referred collectively as "PEG1K."

In addition, other polymers may be used in conjunction with the compounds of described herein in order to optimize their physical properties. For example poly(2-ethyl 2-oxazoline) conjugates have variable hydrophobicity and sufficient size to enhance duration of action (Mero, A., et al. (2008) J Control Release 125: 87-95). Linkage of such a polymer to a saccharide yields a class of surfactant suitable for use in modification of peptides and/or proteins described herein.

Polyethylene glycol chains are functionalized to allow their conjugation to reactive groups on the peptide and/or protein chain. Typical functional groups allow reaction with amino, carboxyl or sulfhydryl groups on the peptide through the corresponding carboxyl, amino or maleimido groups (and the like) on the polyethylene glycol chain. In an embodiment, PEG comprises a $C_{10}$-$C_{3000}$ chain. In another embodiment, PEG has a molecular weight above 40,000 Daltons. In yet another embodiment, PEG has a molecular weight below 10,000 Daltons. PEG as a protein modification is well known in the art and its use is described, for example, in U.S. Pat. Nos. 4,640,835; 4,496,689; 4,301,144; 4,670,417; 4,791,192; and 4,179,337.

A non-traditional type of PEG chain is modified to be amphiphilic in nature. That is it has both the hydrophilic PEG structure but is modified to contain hydrophobic regions such as fatty acid esters and other hydrophobic components. See for example (Miller, M. A., et al. (2006) Bioconjug Chem 17: 267-274); Ekwuribe, et al. U.S. Pat. No. 6,309,633; Ekwuribe, et al. U.S. Pat. No. 6,815,530; Ekwuribe, et al. U.S. Pat. No. 6,835,802). Although these amphiphilic PEG conjugates to proteins were originally developed to increase oral bioavailability they were relatively ineffective in this role. However the use of such amphiphilic PEG conjugates with amphipathic peptides will give significantly prolonged residence in the lung to extend the useful biological activity of these pharmaceuticals. The preferred PEG chains are in the molecular weight range of 500 to 3000 Da. Detailed descriptions of the methods of synthesis of these conjugates is given in the references above, the full content of which is incorporated herein.

A PEG entity itself does not have a functional group to be attached to a target molecular, such as a peptide. Therefore, to create PEG attachment, a PEG entity must be functionalized first, then a functionalized attachment is used to attach the PEG entity to a target molecule, such as a peptide (Greenwald, R. B., et al. (2003) Adv Drug Deliv Rev 55: 217-250, Veronese, F. M. and Pasut, G. (2005) Drug Discov Today 10: 1451-1458, Roberts, M. J., et al. (2002) Adv Drug Deliv Rev 54: 459-476). In one embodiment, site-specific PEGylation can be achieved through Cys substitution on a peptide molecule. The target peptide can be synthesized by solid phase synthesis, recombinant means, or other means, as described herein.

Thus in some embodiments, a peptide product described herein comprises a Lys or other reactive residue modified with an alkyl glycoside and specific PEGylation on at least one Cys residue, a Lys residue or other reactive amino acid residue elsewhere in the molecule.

In another embodiment, a Lys or other residue residue with a nucleophilic side chain may be used for incorporation of the PEG residue. This may be accomplished through the use of an amide or carbamate linkage to a PEG-carboxyl or PEG-carbonate chain. See for example as described (Veronese, F. M. and Pasut, G. (2005) Drug Discov Today 10: 1451-1458). An alternative approach is to modify the Lys side chain amino function through attachment of an SH containing residue, such as mercaptoacetyl, mercaptopropionyl (CO—CH$_2$—CH$_2$—CH$_2$—SH), and the like. Alternatively the PEG chain may be incorporated at the C-Terminus as an amide during the course of the synthesis. Additional methods for attaching PEG chains utilize reaction with the side chains of His and Trp. Other similar methods of modifying the peptide chain to allow attachment of a PEG chain are known in the art and are incorporated herein by reference (Roberts, M. J., et al. (2002) Adv Drug Deliv Rev 54: 459-476).

Formulations

In one embodiment, the covalently modified peptides or proteins as disclosed herein are provided in a formulation that further reduces, prevents, or lessens peptide and/or protein association or aggregation in the composition, for example, reduces peptide and/or protein self-association or self-aggregation, or reduces association or aggregation with other peptides or proteins when administered to the subject.

Self-Association at high protein concentration is problematic in therapeutic formulations. For example, self-association increases the viscosity of a concentrated monoclonal antibody in aqueous solution. Concentrated insulin preparations are inactivated by self aggregation. These self associating protein interactions, particularly at high protein concentration, reduce, modulate or obliterate biological activity of many therapeutics (Clodfelter, D. K., et al. (1998) Pharm Res 15: 254-262). Therapeutic proteins formulated at high concentrations for delivery by injection or other means can be physically unstable or become insoluble as a result of these protein interactions.

A significant challenge in the preparation of peptide and protein formulations is to develop manufacturable and stable dosage forms. Physical stability properties, critical for processing and handling, are often poorly characterized and difficult to predict. A variety of physical instability phenomena are encountered such as association, aggregation, crystallization and precipitation, as determined by protein interaction and solubility properties. This results in significant manufacturing, stability, analytical, and delivery challenges. Development of formulations for peptide and protein drugs requiring high dosing (on the order of mg/kg) are required in many clinical situations. For example, using the SC route, approximately <1.5 mL is the allowable administration volume. This may require >100 mg/mL protein concentrations to achieve adequate dosing. Similar considerations exist in developing a high-concentration lyophilized formulation for monoclonal antibodies. In general, higher protein concentrations permit smaller injection volume to be used which is very important for patient comfort, convenience, and compliance. The surfactant-modified compounds described herein are designed to minimize such aggregation events and may be further facilitated through the use of small amounts of surfactants as herein described.

Because injection is an uncomfortable mode of administration for many people, other means of administering peptide therapeutics have been sought. Certain peptide and protein therapeutics may be administered, for example, by intranasal, buccal, oral, vaginal, inhalation, or other transmucosal administration. Examples are nafarelin (Synarel®) and calcitonin which are administered as commercial nasal spray formulations. The covalently modified peptides and/or proteins described herein are designed to facilitate such transmucosal administration and such formulations may be further facilitated through the use of small amounts of surfactants as described herein.

Typical formulation parameters include selection of optimum solution pH, buffer, and stabilizing excipients. Additionally, lyophilized cake reconstitution is important for lyophilized or powdered formulations. A further and significant problem comprises changes in viscosity of the protein formulation upon self-association. Changes in viscosity can significantly alter delivery properties e.g., in spray (aerosol) delivery for intranasal, pulmonary, or oral cavity sprays. Furthermore, increased viscosity can make injection delivery by syringe or iv line more difficult or impossible.

Many attempts to stabilize and maintain the integrity and physiological activity of peptides have been reported. Some attempts have produced stabilization against thermal denaturation and aggregation, particularly for insulin pump systems. Polymeric surfactants are described (Thurow, H. and Geisen, K. (1984) Diabetologia 27: 212-218; Chawla, A. S., et al. (1985) Diabetes 34: 420-424). The stabilization of insulin by these compounds was believed to be of a steric nature. Among other systems used are saccharides (Arakawa, T. and Timasheff, S. N. (1982) Biochemistry 21: 6536-6544), osmolytes, such as amino acids (Arakawa, T. and Timasheff, S. N. (1985) Biophys J 47: 411-414), and water structure breakers, such as urea (Sato, S., et al. (1983) J Pharm Sci 72: 228-232). These compounds exert their action by modulating the intramolecular hydrophobic interaction of the protein or peptide.

Various peptides, peptides, or proteins are described herein and may be modified with any of the covalently bound surfactant reagents described herein. Advantageously, the peptide modifications described herein comprise covalent attachment of a surfactant that comprises both hydrophilic (e.g. saccharide) and hydrophobic (e.g. alkyl chain) groups, thereby allowing for stabilization of the peptide in physiological conditions. In some embodiments, covalent linkage of a moiety comprising a hydrophilic group and hydrophobic group (e.g. a glycoside surfactant) to a peptide, and/or protein described herein eliminates the need for modifying the amino acid sequence of the peptide, and/or protein to enhance stability (e.g., reduce aggregation).

In some embodiments, the formulations comprise at least one drug comprising a peptide modified with a surfactant derived reagent described herein and in formulation additionally may be associated with a surfactant, wherein the surfactant is further comprised of, for example, a saccharide, an alkyl glycoside, or other excipient and can be administered in a format selected from the group consisting of a drop, a spray, an aerosol, a lyophilizate, a spray dried product, an injectable, and a sustained release format. The spray and the aerosol can be achieved through use of the appropriate dispenser and may be administered by intranasal, transbuccal, inhalation or other transmucosal route. The lyophilizate may contain other compounds such as mannitol, saccharides, submicron anhydrous α-lactose, gelatin, biocompatible gels or polymers. The sustained release format can be an ocular insert, erodible microparticulates, hydrolysable polymers, swelling mucoadhesive particulates, pH sensitive microparticulates, nanoparticles/latex systems, ion-exchange resins and other polymeric gels and implants (Ocusert, Alza Corp., California; Joshi, A., S. Ping and K. J. Himmelstein, Patent Application WO 91/19481). Significant oral bioavailability is also achievable.

The peptide and protein modifications described herein mitigate and, in some cases, may eliminate the need for organic solvents. Trehalose, lactose, and mannitol and other saccharides have been used to prevent aggregation. Aggregation of an anti-IgE humanized monoclonal antibody was minimized by formulation with trehalose at or above a molar ratio in the range of 300:1 to 500:1 (excipient:protein). However, the powders were excessively cohesive and unsuitable for aerosol administration or exhibited unwanted protein glycation during storage (Andya, J. D., et al. (1999) Pharm Res 16: 350-358). Each of the additives discovered have limitations as additives to therapeutics including xenobiotic metabolism, irritation or toxicity, or high cost. Contemplated for use with the covalently modified peptides and/or proteins described herein are excipients that are effective, non-irritating and non-toxic, do not require xenobiotic metabolism since they are comprised of the natural sugars, fatty acids, or long chain alcohols, and which may also be used to minimize aggregation in aqueous solutions or upon aqueous reconstitution of dried peptide and/or protein formulations in situ by physiologic aqueous reconstitution by aqueous body fluids such as plasma or saliva.

Other formulation components could include buffers and physiological salts, non-toxic protease inhibitors such as aprotinin and soybean trypsin inhibitor, alpha-1-antitrypsin, and protease-inactivating monoclonal antibodies, among others. Buffers could include organics such as acetate, citrate, gluconate, fumarate, malate, polylysine, polyglutamate, chitosan, dextran sulfate, etc. or inorganics such as phosphate, and sulfate. Such formulations may additionally contain small concentrations of bacteriostatic agents like benzyl alcohol, and the like.

Formulations suitable for intranasal administration also comprise solutions or suspensions of the modified peptides and/or protein products described herein in an acceptable evaporating solvents such as hydrofluoroalkanes. Such formulations are suitable for administration from metered dose inhalers (MDI) and have advantages of lack of movement from site of administration, low irritation and absence of need for sterilization. Such formulations may also contain acceptable excipients or bulking agents such as submicron anhydrous α-lactose.

In yet another aspect, the covalently modified peptides and/or proteins described herein exhibit increased shelf-life. As used herein, the phrase "shelf life" is broadly described as the length of time a product may be stored without becoming unsuitable for use or consumption. The "shelf life" of the composition described herein, can also indicate the length of time that corresponds to a tolerable loss in quality of the composition. The compositional shelf life as used herein is distinguished from an expiration date; "shelf life" relates to the quality of the composition described herein, whereas "expiration date" relates more to manufacturing and testing requirements of the composition. For example, a composition that has passed its "expiration date" may still be safe and effective, but optimal quality is no longer guaranteed by the manufacturer.

In some embodiments, the modified peptides described herein have greater bioavailability comparted to the unmodified peptide. In some embodiments, the bioavailability is greater for the modified peptides compared to the unmodified peptide when administered by nasal routes. In some embodiments, the bioavailability is greater for the modified peptides compared to the unmodified peptide when administered by buccal. In some embodiments, the bioavailability is greater for the modified peptides compared to the unmodified peptide when administered by oral routes. In some embodiments, the bioavailability is greater for the modified peptides compared to the unmodified peptide when administered by vaginal routes. In some embodiments, the bioavailability is greater for the modified peptides compared to the unmodified peptide when administered by inhalation routes. In some embodiments, the bioavailability is greater for the modified peptides compared to the unmodified peptide when administered by intravenous routes. In some embodiments, the bioavailability is greater for the modified peptides compared to the unmodified peptide when administered by subcutaneous routes. In some embodiments, the bioavailability of the modified peptides described herein have between 10-90%, 20-80%, 30-60%, 10-30%, 15-30%, 15-45%, 50-75%, 60-75%, 70-90%, 80-100%, 100-1000%, 100-500%, 50-200%, or 100-200% greater bioavailability when compared with the unmodified peptide. In some embodiments, the bioavailability of the modified peptides described herein have at least 10%, at least 15%, at least 20%, at least 25%, at least 30%, at least 35%, at least 40%, at least 45%, at least 50%, at least 60%, at least 70%, at least 80%, at least 90%, at least 100%, at least 120%, at least 140%, at least 160%, at least 180%, at least 200%, at least 220%, at least 240%, at least 260%, at least 280%, at least 300%, at least 400%, at least 500%, at least 600%, at least 700%, at least 800%, at least 900%, at least 1000%, about 10%, about 15%, about 20%, about 25%, about 30%, about 35%, about 40%, about 45%, about 50%, about 60%, about 70%, about 80%, about 90%, about 100%, about 120%, about 140%, about 160%, about 180%, about 200%, about 220%, about 240%, about 260%, about 280%, about 300%, about 400%, about 500%, about 600%, about 700%, about 800%, about 900% or about 1000% greater bioavailability when compared with the unmodified peptide.

Methods

In one aspect, provided herein are methods of administering to a subject in need thereof an effective amount of the therapeutic compositions described herein. As used herein, "therapeutically effective amount" is interchangeable with "effective amount" for purposes herein, and is determined by such considerations as are known in the art. The amount must be effective to achieve a desired drug-mediated effect in the treated subjects suffering from the disease thereof. A therapeutically effective amount also includes, but is not limited to, appropriate measures selected by those skilled in the art, for example, improved survival rate, more rapid recovery, or amelioration, improvement or elimination of symptoms, or other acceptable biomarkers or surrogate markers.

The compositions described herein are delivered to a vertebrate subject in need of treatment including but not limited to, for example, a human. Moreover, depending on the condition being treated, these therapeutic compositions may be formulated and administered systemically or locally. Techniques for formulation and administration may be found in the latest edition of "Remington's Pharmaceutical Sciences" (Mack Publishing Co, Easton Pa.). Suitable routes may, for example, include oral or transmucosal administration; such as intranasal; buccal; ocular, vaginal; rectal; as well as parenteral delivery, including intramuscular, subcutaneous, intravenous, or intraperitoneal administration.

In some embodiments of the methods, the effective amount of the peptide product for administration is from about 0.1 µg/kg/day to about 100.0 µg/kg/day, or from 0.01 µg/kg/day to about 1 mg/kg/day or from 0.1 µg/kg/day to about 50 mg/kg/day. In some embodiments, the peptide product is administered parenterally. In some embodiments, the peptide product is administered subcutaneously. In some embodiments, the method of administration of the peptide product is nasal insufflation.

It will be understood, however, that the specific dose level and frequency of dosage for any particular subject in need of treatment may be varied and will depend upon a variety of factors including the activity of the specific compound employed, the metabolic stability and duration of action of that compound, the age, body weight, general health, sex, diet, mode and time of administration, rate of excretion, drug combination, the severity of the particular condition, and the host undergoing therapy.

In one embodiment, provided is a method for chemically modifying a molecule by covalent linkage to a surfactant to increase or sustain the biological action of the composition or molecule, for example, receptor binding or enzymatic activity. In some embodiments, the molecule is a peptide. The method additionally can include further modification comprising covalent attachment of the molecule in the composition to a polymer such as polyethylene glycol.

The method(s) includes all aspects of the compositions described herein including but not limited to compositions which reduce or eliminate immunogenicity of peptide and/or protein drugs, are non-irritating, have anti-bacterial or anti-fungal activity, have increased stability or bioavailability of a drug, decrease the bioavailability variance of that drug, avoid first pass liver clearance and reduce or eliminate any adverse effects. As used herein, the term "immunogenicity" is the ability of a particular substance or composition or agent to provoke an immunological response. The immunogenicity of the covalently modified peptides and/or proteins described herein is confirmed by methods known in the art.

Also provided is a method of administering a drug composition comprising a peptide covalently linked to at least one alkyl glycoside and delivered to a vertebrate, wherein the alkyl has from 1 to 30 carbon atoms, or further in the range of 6 to 16 carbon atoms, and the alkyl glycoside increases the stability, bioavailability and/or duration of action of the drug.

In another embodiment, provided is a method of reducing or eliminating immunogenicity of a peptide and/or protein drug by covalently linking the peptide chain to at least one alkyl glycoside wherein the alkyl has from 1 to 30 carbon atoms.

Throughout this application, various publications are referenced. One skilled in the art will understand that the referenced disclosures of these publications are hereby incorporated by reference into this application.

Methods of Treatment

Provided herein, in some embodiments are methods for treatment of pain, including post-operative or chronic pain, comprising administration of of a surfactant-modified peptide and/or protein product described herein (e.g., a peptide product of Formula I, II or III) to individuals in need thereof. In some of such embodiments, the opioid analogs described herein are not addictive or habit forming, and/or are administered in lower dosages compared to current medications (e.g., codeine) and are longer lasting compared to current medications.

Provided herein, in some embodiments are methods for prevention and/or treatment of conditions associated with hypoparathyroidism and/or decreases in bone mass density comprising administration of a therapeutically effective amount of a surfactant-modified peptide and/or protein product described herein (e.g., a peptide product of Formula 2-I-A, 2-III, 2-V, 2-VI or 2-VII) to individuals in need thereof. In some embodiments, the conditions characterized by decreases in bone mass density include, and are not limited to, osteoporosis, osteopenia, post-menopausal osteoporosis, Paget's disease, glucocorticoid induced osteoporosis, old age osteoporosis, humoral hypercalcemia, or the like.

In some embodiments, provided herein are methods for treatment of hypoparathyroidism comprising administration of a therapeutically effective amount of a surfactant-modified peptide and/or protein product described herein (e.g., a peptide product of Formula 2-I-A, 2-III, 2-V, 2-VI or 2-VII) to individuals in need thereof. In some embodiments, the hypoparathyroidism is associated with decrease in bone mass density.

Further provided herein are methods for stimulating bone repair and/or favoring engraftment of a bone implant comprising administration of a therapeutically effective amount of a surfactant-modified peptide and/or protein product described herein (e.g., a peptide product of Formula 2-I-A, 2-III, 2-V, 2-VI or 2-VII) to individuals in need thereof.

In yet further embodiments, provided herein are methods for increasing bone density and/or reducing incidence of fractures (e.g., vertebrae fractures, hip fractures, or the like) comprising administration of a therapeutically effective amount of a surfactant-modified peptide and/or protein product described herein (e.g., a peptide product of Formula 2-I-A, 2-III, 2-V, 2-VI or 2-VII) to individuals in need thereof.

In some embodiments, provided herein are methods for treatment of humoral hypercalcemia comprising administration of a therapeutically effective amount of a surfactant-modified peptide and/or protein product described herein (e.g., a peptide product of Formula 2-I-A, 2-III, 2-V, 2-VI or 2-VII) to individuals in need thereof. In some embodiments, humoral hypercalcemia is associated with tumors. In some of such embodiments, the peptide product (e.g., a peptide product of Formula 2-I-A, 2-III, 2-V, 2-VI or 2-VII) is an inverse agonist or an antagonist of PTH or PTHrP.

In some embodiments of the methods described above, the peptide and/or protein that is covalently attached to a surfactant is PTH, PTHrP, or an analog thereof. In some embodiments, the surfactant-modified peptide and/or protein (e.g., a peptide product of Formula 2-I-A, 2-III, 2-V, 2-VI or 2-VII) is administered prophylactically and delays occurrence of any condition associated with loss of bone density, including and not limited to osteoporosis, osteopenia, post-menopausal osteoporosis, Paget's disease, glucocorticoid induced osteoporosis, old age osteoporosis, or the like. In some embodiments, the surfactant-modified peptide and/or protein (e.g., a peptide product of Formula 2-I-A, 2-III, 2-V, 2-VI or 2-VII) is administered therapeutically and delays progression of any condition associated with loss of bone density, including and not limited to osteoporosis, osteopenia, post-menopausal osteoporosis, Paget's disease, glucocorticoid induced osteoporosis, humoral hypercalcemia, or the like. In some embodiments, the surfactant-modified peptide and/or protein (e.g., a peptide product of Formula 2-I-A, 2-III, 2-V, 2-VI or 2-VII) is administered prophylactically and/or therapeutically and delays progression of osteopenia to osteoporosis. In some embodiments, the surfactant-modified peptide and/or protein (e.g., a peptide product of Formula 2-I-A, 2-III, 2-V, 2-VI or 2-VII) is administered prophylactically and/or therapeutically and reduces or halts further loss of bone density, thereby stabilizing disease.

In some embodiments, the surfactant-modified peptide and/or protein (e.g., a peptide product of Formula 2-I-A, 2-III, 2-V, 2-VI or 2-VII) is administered parenterally. In some embodiments, the surfactant-modified peptide and/or protein (e.g., a peptide product of Formula 2-I-A, 2-III, 2-V, 2-VI or 2-VII) is administered subcutaneously. In some embodiments, the surfactant-modified peptide and/or protein (e.g., a peptide product of Formula 2-I-A, 2-III, 2-V, 2-VI or 2-VII) is administered by nasal insufflation.

In some embodiments of the methods described above, the surfactant-modified peptide and/or protein (e.g., a peptide product of Formula 2-I-A, 2-III, 2-V, 2-VI or 2-VII) has a longer duration of action compared to a pharmaceutical comprising currently known therapeutics (e.g., recombinant PTH, bisphosphonates, antibody Denosumab, or the like). In some embodiments, the surfactant-modified peptide and/or protein (e.g., a peptide product of Formula 2-I-A, 2-III, 2-V, 2-VI or 2-VII) is administered for longer period of time (e.g., >two years) compared to a pharmaceutical comprising currently known therapeutics (e.g., recombinant PTH, bisphosphonates, antibody Denosumab, or the like) while reducing or ameliorating side-effects (e.g., osteonecrosis in jaw, skin infections or the like) associated with currently known therapeutics (e.g., recombinant PTH, bisphosphonates, antibody Denosumab, or the like). In some embodiments of the methods described above, the surfactant-modified peptide and/or protein (e.g., a peptide product of Formula 2-I-A, 2-III, 2-V, 2-VI or 2-VII) is an agonist of PTH or PTHrP. In some embodiments of the methods described above, the surfactant-modified peptide and/or protein (e.g., a peptide product of Formula 2-I-A, 2-III, 2-V, 2-VI or 2-VII) is an antagonist of PTH or PTHrP. In some embodiments of the methods described above, the surfactant-modified peptide and/or protein (e.g., a peptide product of Formula 2-I-A, 2-III, 2-V, 2-VI or 2-VII) is an inverse agonist of PTH or PTHrP.

Provided herein, in some embodiments are methods for prevention and/or treatment of conditions associated with decreases in insulin sensitivity comprising administration of a therapeutically effective amount of a surfactant-modified peptide and/or protein product described herein (e.g., a peptide product of Formula 3-I-A, 3-III-A, 3-III-B or Formula 3-V) to individuals in need thereof. In some embodiments, the conditions characterized by decreases in insulin sensitivity include, and are not limited to, the metabolic syndrome, obesity-related insulin resistance, hypertension, systemic inflammation associated with high C reactive protein, diabetes, or the like.

Also provided is a method of treating conditions associated with insulin resistance including and not limited to obesity, the metabolic syndrome, type 2 diabetes, hypertension, atherosclerosis or the like, comprising administering a drug composition comprising a peptide covalently linked to at least one alkyl glycoside and delivered to a vertebrate, wherein the alkyl has from 1 to 30 carbon atoms, or further in the range of 6 to 18 carbon atoms (e.g., a peptide product of Formula 3-I-A, 3-III-A, 3-III-B or Formula 3-V), and wherein covalent linkage of the alkyl glycoside to the peptide increases the stability, bioavailability and/or duration of action of the drug.

Also provided herein are methods for treatment of insulin resistance comprising administration of a therapeutically effective amount of a surfactant-modified peptide and/or protein product described herein (e.g., a peptide product of Formula 3-I-A, 3-III-A, 3-III-B or Formula 3-V) to individuals in need thereof. In some embodiments, the insulin resistance is associated with the metabolic syndrome (Syndrome X) and/or diabetes.

Further provided herein are methods for stimulating resensitization of the body to insulin comprising administration of a therapeutically effective amount of a surfactant-modified peptide and/or protein product described herein (e.g. a peptide product of Formula 3-I-A, 3-III-A, 3-III-B or Formula 3-V) to individuals in need thereof.

In yet further embodiments, provided herein are methods for increasing insulin sensitivity through weight loss, comprising administration of a therapeutically effective amount of a surfactant-modified peptide and/or protein product described herein (e.g. a peptide product of Formula 3-I-A, 3-III-A, 3-III-B or Formula 3-V and in Table 1 of FIG. 1 and Table 2 of FIG. 2) to individuals in need thereof.

Also provided herein are methods of treating diabetes or prediabetes comprising administering to a subject in need thereof a therapeutically effective amount of a peptide product described above and herein and in Table 1 of FIG. 1 and Table 2 of FIG. 2 to an individual in need thereof.

Provided herein are methods for treating or delaying the progression or onset of conditions selected from diabetes, diabetic retinopathy, diabetic neuropathy, diabetic nephropathy, insulin resistance, hyperglycemia, hyperinsulinemia, metabolic syndrome, diabetic complications, elevated blood levels of free fatty acids or glycerol, hyperlipidemia, obesity, hypertriglyceridemia, atherosclerosis, acute cardiovascular syndrome, infarction, ischemic reperfusion a hypertension, comprising administering a therapeutically effective amount of a peptide product described herein and in Table 1 of FIG. 1 and Table 2 of FIG. 2 to an individual in need thereof. In an additional embodiment, provided herein are methods for treating delays in wound healing comprising administering a therapeutically effective amount of a peptide product described herein and in Table 1 of FIG. 1 and Table 2 of FIG. 2 to an individual in need thereof.

In one embodiment said condition to be treated is diabetes. In one embodiment said condition to be treated is insulin resistance. In one embodiment said condition to be treated is the metabolic syndrome. In one embodiment said effective amount of said peptide is from about 0.1 µg/kg/day to about 100.0 µg/kg/day.

In one embodiment the method of administration is parenteral. In one embodiment the method of administration is per oral. In one embodiment the method of administration is subcutaneous. In one embodiment the method of administration is nasal insufflation.

Further provided herein is a method of reducing weight gain or inducing weight loss comprising administering a therapeutically effective amount of a peptide product described herein and in Table 1 of FIG. 1 and Table 2 of FIG. 2 to an individual in need thereof. In some embodiments, the weight gain is associated with metabolic syndrome.

Provided herein is a method of treating hypoglycemia comprising administering a therapeutically effective amount of a peptide product described herein and in Table 1 of FIG. 1 and Table 2 of FIG. 2 to an individual in need thereof.

Also provided herein are methods for treatment of diabetes comprising administering a therapeutically effective amount of a peptide product described herein and in Table 1 of FIG. 1 and Table 2 of FIG. 2 to an individual in need thereof and at least one additional therapeutic agent; wherein said therapeutic agent is selected from an antidiabetic agent, an anti-obesity agent, a satiety agent, an anti-inflammatory agent, an anti-hypertensive agent, an anti-atherosclerotic agent and a lipid-lowering agent.

In some embodiments of the methods described above, the peptide and/or protein that is covalently attached to a surfactant is a glucagon or GLP-1 peptide, or an analog thereof. In some embodiments, the surfactant-modified peptide and/or protein (e.g., a peptide product of Formula 3-I-A, 3-III-A, 3-III-B or Formula 3-V) is administered prophylactically and delays occurrence of any condition associated with insulin resistance, including and not limited to the metabolic syndrome, hypertension, diabetes, type 2 diabetes, gestational diabetes, hyperlipidemia, atherosclerosis, systemic inflammation or the like. In some embodiments, the surfactant-modified peptide and/or protein (e.g., a peptide product of Formula 3-I-A, 3-III-A, 3-III-B or Formula 3-V) is administered therapeutically and delays progression of any condition associated with the metabolic syndrome, hypertension, diabetes, type 2 diabetes, gestational diabetes, hyperlipidemia, atherosclerosis, systemic inflammation or the like. In some embodiments, the surfactant-modified peptide and/or protein (e.g., a peptide product of Formula 3-I-A, 3-III-A, 3-III-B or Formula 3-V) is administered prophylactically and/or therapeutically and delays progression of insulin resistance to diabetes. In some embodiments, the surfactant-modified peptide and/or protein (e.g., a peptide product of Formula 3-I-A, 3-III-A, 3-III-B or Formula 3-V) is administered prophylactically and/or therapeutically and reduces or halts further loss of insulin resistance, thereby stabilizing disease.

In some embodiments, the surfactant-modified peptide and/or protein (e.g., a peptide product of Formula 3-I-A, 3-III-A, 3-III-B or Formula 3-V) is administered parenterally. In some embodiments, the surfactant-modified peptide and/or protein (e.g., a peptide product of Formula 3-I-A, 3-III-A, 3-III-B or Formula 3-V) is administered subcutaneously. In some embodiments, the surfactant-modified peptide and/or protein (e.g., a peptide product of Formula 3-I-A, 3-III-A, 3-III-B or Formula 3-V) is administered by nasal insufflation.

In some embodiments of the methods described above, the surfactant-modified peptide and/or protein (e.g., a peptide product of Formula 3-I-A, 3-III-A, 3-III-B or Formula 3-V) has a longer duration of action compared to a pharmaceutical comprising currently known therapeutics (e.g., exenatide, metformin or the like).

Combination Therapy with PTH Analogs

Is some embodiments of the methods described above, the surfactant-modified peptide and/or protein (e.g., a peptide product of Formula 2-I-A, 2-III, 2-V, 2-VI or 2-VII) is administered in combination with a bone resorption inhibitor including, a bisphosphonate, (e.g. alendronate) or strontium salt; or a substance with estrogen-like effect, e.g. estrogen; or a selective estrogen receptor modulator, e.g. raloxifene, tamoxifene, droloxifene, toremifene, idoxifene, or levormeloxifene; or a calcitonin-like substance, e.g. calcitonin; or a vitamin D analog; or a calcium salt. The therapeutic agents are optionally administered simultaneously, or sequentially in any order. By way of example, in some embodiments of the methods described above, a first regimen of the surfactant-modified peptide and/or protein (e.g., a peptide product of Formula 2-I-A, 2-III, 2-V, 2-VI or 2-VII) is administered to an individual in need thereof, and the regimen is followed by a second regimen of bisphosphonate therapy. By way of example, in some other embodiments, a first regimen of the surfactant-modified peptide and/or protein (e.g., a peptide product of Formula 2-I-A, 2-III, 2-V, 2-VI or 2-VII) is administered to an individual in need thereof, followed by a drug holiday, followed by a second regimen of estrogen receptor modulators.

Combination Therapy with GLP Analogs

In some embodiments of the methods described above, the surfactant-modified peptide and/or protein (e.g., a peptide product of Formula 3-I-A, 3-III-A, 3-III-B or Formula 3-V) is administered in combination with other methods of treatment of the metabolic syndrome selected from the group comprising an antidiabetic agent, an anti-obesity agent, an anti-hypertensive agent, an anti-atherosclerotic agent and a lipid-lowering agent. By way of example, efficacious antidiabetic agents suitable for administration in combination with a surfactant-modified peptide and/or protein product described herein include a biguanide, a sulfonylurea, a glucosidase inhibitor a PPAR γ agonist, a PPAR α/γ dual agonist, an aP2 inhibitor, a DPP4 inhibitor, an insulin sensitizer, a GLP-1 analog, insulin and a meglitinide. Additional examples include metformin, glyburide, glimepiride, glipyride, glipizide, chlorpropamide, gliclazide, acarbose, miglitol, pioglitazone, troglitazone, rosiglitazone, muraglitazar, insulin, Gl-262570, isaglitazone, JTT-501, NN-2344, L895 645, YM-440, R-119702, A19677, repaglinide, nateglinide, KAD 1129, AR-HO 39242, GW-40 I 5 44, KRP2 I 7, AC2993, LY3 I 5902, NVP-DPP-728A and saxagliptin.

In some embodiments of the methods described above, the surfactant-modified peptide and/or protein (e.g., a peptide product of Formula 3-I-A, 3-III-A, 3-III-B or Formula 3-V) is administered in combination with other methods of treatment of the metabolic syndrome selected from the group of efficacious anti-obesity agents. By way of example, efficacious anti-obesity agents suitable for administration with the peptide products described herein include beta 3 adrenergic agonist, a lipase inhibitor, a serotonin (and dopamine) reuptake inhibitor, a thyroid receptor beta compound, a CB-1 antagonist, a NPY-Y2 and a NPY-Y4 receptor agonist and an anorectic agent. Specific members of these classes comprise orlistat, AfL-962, A19671, L750355, CP331648, sibutramine, topiramate, axokine, dexamphetamine, phentermine, phenylpropanolamine, rimonabant (SR1 417164), and mazindol.

In some embodiments of the methods described above, the surfactant-modified peptide and/or protein (e.g., a peptide product of Formula 3-I-A, 3-III-A, 3-III-B or Formula 3-V) is administered in combination with other methods of treatment of the metabolic syndrome selected from the group of efficacious lipid-lowering agents. By way of example, efficacious lipid-lowering agents suitable for administration with the peptide products described herein include agents selected from the group consisting of an MTP inhibitor, cholesterol ester transfer protein, an HMG CoA reductase inhibitor, a squalene synthetase inhibitor, a fibric acid derivative, an upregulator of LDL receptor activity, a lipoxygenase inhibitor, and an ACAT inhibitor. Specific examples from these classes comprise pravastatin, lovastatin, simvastatin, atorvastatin, cerivastatin, fluvastatin, nisvastatin, visastatin, fenofibrate, gemfibrozil, clofibrate, avasimibe, TS-962, MD-700, CP-52941 4, and LY295 427.

In some embodiments of the methods described above, the surfactant-modified peptide and/or protein (e.g., a peptide product of Formula 3-I-A, 3-III-A, 3-III-B or Formula 3-V) is administered in combination with peptide hormones, and analogs thereof, that are known to exhibit pro-satiety effects in animal models and in man. Contemplated within the scope of embodiments presented herein is a combination of the peptide products described herein and long-acting satiety agents for treatment of obesity. Examples of such peptide satiety agents include GLP-1, pancreatic polypeptide (PP), cholecystokinin (CCK), peptide YY (PYY), amylin, calcitonin, OXM, neuropeptide Y (NPY), and analogs thereof (Bloom, S. R., et al. (2008) Mol Intery 8: 82-98; Field, B. C., et al. (2009) Br J Clin Pharmacol 68: 830-843).

Also contemplated within the scope of embodiments presented herein are methods for treatment of obesity comprising administration of peptide products described herein in combination with peptide hormones including and not limited to leptin, ghrelin and CART (cocaine- and amphetamine-regulated transcript) analogs and antagonists.

Additional peptide products in the body are associated with fat cells or the obese state (adipokines) and are known to have proinflammatory effects (Gonzalez-Periz, A. and Claria, J. (2010) ScientificWorldJournal 10: 832-856). Such agents will have additional favorable actions when used in combination with the peptide products described herein. Examples of agents that offer a beneficial effect when used in combination with the peptide products described herein include analogs and antagonists of adiponectin, chemerin, visfatin, nesfatin, omentin, resistin, TNFalpha, IL-6 and obestatin.

Dosing

The covalently modified peptides and/or proteins described herein may be administered in any amount to impart beneficial therapeutic effect in a number of disease states. In some embodiments, covalently modified peptides and/or proteins described herein are useful in the treatment of inflammation. In an embodiment, compounds presented herein impart beneficial activity in the modulation of post-operative or chronic pain. In an embodiment, the present peptides are administered to a patient at concentrations higher or lower than that of other forms of treatment which modulate pain. In yet another embodiment, the present peptides are administered with other compounds to produce synergistic therapeutic effects.

Representative delivery regimens include oral, parenteral (including subcutaneous, intramuscular and intravenous injection), rectal, buccal (including sublingual), transdermal, inhalation ocular and intranasal. An attractive and widely used method for delivery of peptides entails subcutaneous injection of a controlled-release injectable formulation. In some embodiments, covalently modified peptides and/or proteins described herein are useful for subcutaneous, intranasal and inhalation administration.

The selection of the exact dose and composition and the most appropriate delivery regimen will be influenced by, inter alia, the pharmacological properties of the selected peptide, the nature and severity of the condition being treated, and the physical condition and mental acuity of the recipient. Additionally, the route of administration will result in differential amounts of absorbed material. Bioavailabilities for administration of peptides through different routes are particularly variable, with amounts from less than 1% to near 100% being seen. Typically, bioavailability from routes other than intravenous, intraperitoneal or subcutaneous injection are 50% or less.

In general, covalently modified peptides and/or proteins described herein, or salts thereof, are administered in amounts between about 0.001 and 20 mg/kg body weight per day, between about 0.01 and 10 mg/kg body weight per day, between about 0.1 and 1000 µg/kg body weight per day, or between about 0.1 to about 100 µg/kg body weight per day. Routes of administration vary. For example, covalently modified opiod peptides and/or proteins described herein, or salts thereof, are administered in amounts between about 0.1 and 1000 µg/kg body weight per day, or between about 0.1 to about 100 µg/kg body weight per day, by subcutaneous injection. By way of example, for a 50 kg human female subject, the daily dose of active ingredient is from about 5 to about 5000 µg, or from about 5 to about 5000 µg by subcutaneous injection. Different doses will be needed, depending on the route of administration, the compound potency, the pharmacokinetic profile and the applicable bioavailability observed, and the active agent and the disease being treated. In an alternate embodiment where the administration is by inhalation, the daily dose is from 1000 to about 20,000 µg, twice daily. In other mammals, such as horses, dogs, and cattle, higher doses may be required. This dosage may be delivered in a conventional pharmaceutical composition by a single administration, by multiple applications, or via controlled release, as needed to achieve the most effective results.

Pharmaceutically acceptable salts retain the desired biological activity of the parent peptide without toxic side effects. Examples of such salts are (a) acid addition salts formed with inorganic acids, for example hydrochloric acid, hydrobromic acid, sulfuric acid, phosphoric acid, nitric acid and the like; and salts formed with organic acids such as, for example, acetic acid, trifluoroacetic acid, tartaric acid, succinic acid, maleic acid, fumaric acid, gluconic acid, citric acid, malic acid, ascorbic acid, benzoic acid, tannic acid, pamoic acid, alginic acid, polyglutamic acid, naphthalenesulfonic acids, naphthalene disulfonic acids, polygalacturonic acid and the like; (b) base addition salts or complexes formed with polyvalent metal cations such as zinc, calcium, bismuth, barium, magnesium, aluminum, copper, cobalt, nickel, cadmium, and the like; or with an organic cation formed from N,N'-dibenzylethylenediamine or ethylenediamine; or (c) combinations of (a) and (b), e.g., a zinc tannate salt and the like.

Also contemplated, in some embodiments, are pharmaceutical compositions comprising as an active ingredient covalently modified peptides and/or proteins described herein, or pharmaceutically acceptable salt thereof, in admixture with a pharmaceutically acceptable, non-toxic carrier. As mentioned above, such compositions may be prepared for parenteral (subcutaneous, intramuscular or intravenous) administration, particularly in the form of liquid solutions or suspensions; for oral or buccal administration, particularly in the form of tablets or capsules; for intranasal administration, particularly in the form of powders, nasal drops, evaporating solutions or aerosols; for inhalation, particularly in the form of liquid solutions or dry powders with excipients, defined broadly; and for rectal or transdermal administration.

The compositions may conveniently be administered in unit dosage form and may be prepared by any of the methods well-known in the pharmaceutical art, for example as described in Remington's Pharmaceutical Sciences, 17th ed., Mack Publishing Company, Easton, Pa., (1985), incorporated herein by reference. Formulations for parenteral administration may contain as excipients sterile water or saline, alkylene glycols such as propylene glycol, polyalkylene glycols such as polyethylene glycol, saccharides, oils of vegetable origin, hydrogenated naphthalenes, serum albumin nanoparticles (as used in Abraxane™, American Pharmaceutical Partners, Inc. Schaumburg Ill.), and the like. For oral administration, the formulation can be enhanced by the addition of bile salts or acylcarnitines. Formulations for nasal administration may be solid or solutions in evaporating solvents such as hydrofluorocarbons, and may contain excipients for stabilization, for example, saccharides, surfactants, submicron anhydrous α-lactose or dextran, or may be aqueous or oily solutions for use in the form of nasal drops or metered spray. For buccal administration typical excipients include sugars, calcium stearate, magnesium stearate, pregelatinated starch, and the like.

When formulated for nasal administration, the absorption across the nasal mucous membrane may be further enhanced by surfactants, such as for example, glycocholic acid, cholic acid, taurocholic acid, ethocholic acid, deoxycholic acid, chenodeoxycholic acid, dehydrocholic acid, glycodeoxycholic acid, cyclodextrins and the like in an amount in the range between about 0.1 and 15 weight percent, between about 0.5 and 4 weight percent, or about 2 weight percent. An additional class of absorption enhancers reported to exhibit greater efficacy with decreased irritation is the class of alkyl maltosides, such as tetradecylmaltoside (Arnold, J. J., et al. (2004) J Pharm Sci 93: 2205-2213, Ahsan, F., et al. (2001) Pharm Res 18: 1742-1746) and references therein, all of which are hereby incorporated by reference.

When formulated for delivery by inhalation, a number of formulations offer advantages. Adsorption of the active peptide to readily dispersed solids such as diketopiperazines (for example Technosphere particles; (Pfutzner, A. and Forst, T. (2005) Expert Opin Drug Deliv 2: 1097-1106) or similar structures gives a formulation which results in a rapid initial uptake of the therapeutic agent. Lyophylized powders, especially glassy particles, containing the active peptide and an excipient are useful for delivery to the lung with good bioavailability, for example, see Exubera® (inhaled insulin by Pfizer and Aventis Pharmaceuticals Inc.). Additional systems for delivery of peptides by inhalation are described (Mandal, T. K., Am. J. Health Syst. Pharm. 62: 1359-64 (2005)).

Delivery of covalently modified peptides and/or proteins described herein to a subject over prolonged periods of time, for example, for periods of one week to one year, may be accomplished by a single administration of a controlled release system containing sufficient active ingredient for the desired release period. Various controlled release systems, such as monolithic or reservoir-type microcapsules, depot implants, polymeric hydrogels, osmotic pumps, vesicles, micelles, liposomes, transdermal patches, iontophoretic devices and alternative injectable dosage forms may be utilized for this purpose. Localization at the site to which delivery of the active ingredient is desired is an additional feature of some controlled release devices, which may prove beneficial in the treatment of certain disorders.

One form of controlled release formulation contains the peptide or its salt dispersed or encapsulated in a slowly degrading, non-toxic, non-antigenic polymer such as copoly (lactic/glycolic) acid, as described in the pioneering work of Kent, Lewis, Sanders, and Tice, U.S. Pat. No. 4,675,189, incorporated by reference herein. The compounds, or their salts, may also be formulated in cholesterol or other lipid matrix pellets, or silastomer matrix implants. Additional slow release, depot implant or injectable formulations will be apparent to the skilled artisan. See, for example, Sustained and Controlled Release Drug Delivery Systems, J. R. Robinson ed., Marcel Dekker, Inc., New York, 1978, and R. W. Baker, Controlled Release of Biologically Active Agents, John Wiley & Sons, New York, 1987.

An additional form of controlled-release formulation comprises a solution of a biodegradable polymer, such as copoly(lactic/glycolic acid) or block copolymers of lactic acid and PEG, is bioacceptable solvent, which is injected subcutaneously or intramuscularly to achieve a depot formulation. Mixing of the peptides described herein with such a polymeric formulation is suitable to achieve very long duration of action formulations.

All publications and patent applications mentioned in this specification are herein incorporated by reference to the same extent as if each independent publication or patent application is specifically and individually indicated to be incorporated by reference.

The covalently modified peptides and/or proteins described herein and the reagents for the synthesis thereof are more particularly described in the following examples which are intended as illustrative only since numerous modifications and variations therein will be apparent to those of ordinary skill in the art.

EXAMPLES

Example 1: Reagents—N-α-Fmoc,N-ε-(1-octyl β-D-glucuronide-6-yl)-L-lysine

In an oven-dried 250 mL Erlenmeyer flask is placed 1-octyl β-D-glucuronic acid (Carbosynth Ltd., 3.06 g, 10 mmol), 50 mL anhydrous DMF, and anhydrous HOBT (1.62 g, 12 mmol). A chilled (4° C.) solution of DCC (2.48 g, 12 mmol) in 50 mL of DMF is added, with stirring, and the reaction is allowed to proceed for 5 min. The copious white precipitate of N,N'-dicyclohexylurea is filtered on a fritted glass funnel and the filtrate is added to a solution of N-α-Fmoc-L-lysine (3.68 g, 10 mmol) in 25 ml anhydrous DMF. The reaction is allowed to proceed for 25 min with warming to room temp or until the ninhydrin color is very faint. The reaction mixture is filtered, stripped to dryness and crystallized from MeOH/$Et_2O$ by dissolution in MeOH and slow dilution to the cloud point with $Et_2O$, followed by refrigeration. Further purification can be achieved by silica gel chromatography using a solvent gradient from EtOAc to EtOAc/EtOH/AcOH.

In a similar manner, but substituting N-α-Boc-L-lysine is obtained N-α-Boc,N-ε-(1-octyl β-D-glucuronide-6-yl)-L-lysine, suitable for N-terminal incorporation and cleavage to a free N-Terminus. In a similar manner, but substituting N-α-Ac-L-lysine is obtained N-α-Ac,N-ε-(1-octyl β-D-glucuronide-6-yl)-L-lysine, suitable for incorporation at the N-terminus of a peptide with a blocked N-terminus. In a similar manner, but substituting the appropriate amount of N-α-Fmoc-L-ornithine is obtained N-α-Fmoc,N-δ-(1-octyl β-D-glucuronide-6-yl)-L-ornithine. In a similar manner but substituting other N-mono-protected diamino acids one obtains the corresponding reagents. Alternatively, use of a transient $Me_3Si$ ester protecting group during the coupling and without preactivation of the 1-octyl β-D-glucuronic acid provides a facile route to the formation of the reagents. The transient $Me_3Si$ ester is produced by reaction of the Fmoc-Lys-OH with an equimolar amount of N,O-bis(trimethylsilyl)acetamide in dichloromethane ($CH_2Cl_2$). The organic layer contains the desired reagent as a solution in $CH_2Cl_2$ ready for coupling with the 1-alkyl glucoronide as above. The filtered reaction mixture is washed with aqueous $NaHSO_4$ to hydrolyze the $Me_3Si$ ester, dried over $MgSO_4$ and solvent is removed.

Similarly, but using peracetyl or perbenzoyl 1-octyl β-D-glucuronic acid one obtains the Ac, or Bz protected form of the reagents (e.g. 2,3,4-trisacetyl 1-octyl β-D-glucuronic acid, and the like, formed by treatment with $Ac_2O$). Such reagents have increased stability during acid cleavage from the resin and are used when instability during deprotection is detected, see (Kihlberg, J., et al. (1997) Methods Enzymol 289: 221-245) and references therein. Final deprotection of such products is carried out by base-catalyzed transesterification after cleavage, by use of MeOH/$NH_3$, MeOH/NaOMe, MeOH/$NH_2NH_2$, as described above.

Example 2: Synthetic Peptide Analogs

In general, peptide synthesis methods involve the sequential addition of protected amino acids to a growing peptide chain. Normally, either the amino or carboxyl group of the first amino acid and any reactive side chain group are protected. This protected amino acid is then either attached to an inert solid support, or utilized in solution, and the next amino acid in the sequence, also suitably protected, is added under conditions amenable to formation of the amide linkage. After all the desired amino acids have been linked in the proper sequence, protecting groups and any solid support are removed to afford the crude peptide. The peptide is desalted and purified chromatographically.

A preferred method of preparing the analogs of the physiologically active truncated peptides, having fewer than about fifty amino acids, involves solid phase peptide synthesis. In this method the α-amino (Nα) functions and any reactive side chains are protected by acid- or base-sensitive groups. The protecting group should be stable to the conditions of peptide linkage formation, while being readily removable without affecting the extant peptide chain. Suitable α-amino protecting groups include, but are not limited to t-butoxycarbonyl (Boc), benzyloxycarbonyl (Cbz), o-chlorobenzyloxycarbonyl, biphenylisopropyloxycarbonyl, t-amyloxycarbonyl (Amoc), isobornyloxycarbonyl, α,α-dimethyl-3,5-dimethoxybenzyloxy-carbonyl, o-nitrophenylsulfenyl, 2-cyano-t-butoxycarbonyl, 9-fluorenylmethoxycarbonyl (Fmoc) and the like, preferably Boc or more preferably, Fmoc. Suitable side chain protecting groups include, but are not limited to: acetyl, benzyl (Bzl), benzyloxymethyl (Bom), Boc, t-butyl, o-bromobenzyloxycarbonyl, t-butyl, t-butyldimethylsilyl, 2-chlorobenzyl (Cl-z), 2,6-dichlorobenzyl, cyclohexyl, cyclopentyl, isopropyl, pivalyl, tetrahydropyran-2-yl, tosyl (Tos), 2,2,4,6,7-pentamethyldihydrobenzofuran-5-sulfonyl (Pbf), trimethylsilyl and trityl. A preferred Nα-protecting group for synthesis of the compounds is the Fmoc group. Preferred side chain protecting groups are O-t-Butyl group for Glu, Tyr, Thr, Asp and Ser; Boc group for Lys and Trp side chains; Pbf group for Arg; Trt group for Asn, Gln, and His. For selective modification of a Lys residue, orthogonal protection with a protecting group not removed by reagents that cleave the Fmoc or t-butyl based protecting groups is preferred. Preferred examples for modification of the Lys side chain include, but are not limited to, those removed by hydrazine but not piperidine; for example 1-(4,4-dimethyl-2,6-dioxocyclohex-1-ylidene)-3-methylbutyl (ivDde) or 1-(4,4-dimethyl-2,6-dioxocyclohex-1-ylidene)ethyl (Dde) and allyloxycarbonyl (Alloc).

The Fmoc-Lys(ivDde) or Fmoc-Lys(Dde) protecting group scheme is preferred in cases where side chain lactam formation is desired (Houston, M. E., Jr., et al. (1995) J Pept Sci 1: 274-282; Murage, E. N., et al. (2010) J Med Chem), since in this case Fmoc-Glu(O-Allyl) and Fmoc-Lys(Alloc) can be incorporated and used to provide transient protection, then deprotected for lactam formation while the Lys(Dde) protecting group remains for later removal and reaction with the functionalized surfactant. The side chain lactam between acidic and basic residue (e.g. Glu and Lys) is carried out after removal of the allyl-based protection by activation of the carboxyl side chain function with N,N'-diisopropylcarbodiimide (DIC)/1-hydroxybenzotriazole (HOBt) or 2-(1H-benzotriazole-1-yl)-1,1,3,3-tetramethylaminium hexafluorophosphate (HBTU)/N,N-di-isopropylethylamine (DIEA), using standard protocols well known to the art.

In solid phase synthesis, the C-terminal amino acid is first attached to a suitable resin support. Suitable resin supports are those materials which are inert to the reagents and reaction conditions of the stepwise condensation and deprotection reactions, as well as being insoluble in the media used. Examples of commercially available resins include styrene/divinylbenzene resins modified with a reactive group, e.g., chloromethylated co-poly-(styrene-divinylbenzene), hydroxymethylated co-poly-(styrene-divinylbenzene), and the like. Benzylated, hydroxymethylated phenylacetamidomethyl (PAM) resin is preferred for the preparation of peptide acids. When the C-terminus of the compound is an amide, preferred resins are p-methylbenzhydrylamino-co-poly(styrene-divinyl-benzene) resin, a 2,4 dimethoxybenzhydrylamino-based resin ("Rink amide"), 4-Hydroxymethylphenoxyacetyl aminomethyl resin (HMP Am) and the like. An especially preferred support for the synthesis of larger peptides are commercially available resins containing PEG sequences grafted onto other polymeric matrices, such as the Rink Amide-PEG and PAL-PEG-PS resins (Applied Biosystems) or similar resins designed for peptide amide synthesis using the Fmoc protocol. Thus in certain cases it is desirable to have an amide linkage to a PEG chain. It those cases it is convenient to link an N-Fmoc-amino-PEG-carboxylic acid to the amide forming resin above (e.g. Rink amide resin and the like). The first amino acid of the chain can be coupled as an N-Fmoc-amino acid to the amino function of the PEG chain. Final deprotection will yield the desired Peptide-NH-PEG-CO—NH$_2$ product.

Attachment to the PAM resin may be accomplished by reaction of the Nα protected amino acid, for example the Boc-amino acid, as its ammonium, cesium, triethylammonium, 1,5-diazabicyclo-[5.4.0]undec-5-ene, tetramethylammonium, or similar salt in ethanol, acetonitrile, N,N-dimethylformamide (DMF), and the like, preferably the cesium salt in DMF, with the resin at an elevated temperature, for example between about 40° and 60° C., preferably about 50° C., for from about 12 to 72 hours, preferably about 48 hours. This will eventually yield the peptide acid product following acid cleavage or an amide following aminolysis.

The Nα-Boc-amino acid may be attached to the benzhydrylamine or HMP Am resin by means of, for example, a DIC/HOBt mediated coupling for from about 2 to about 24 hours, preferably about 2 hours at a temperature of between about 10° and 50° C., preferably 25° C. in a solvent such as CH$_2$Cl$_2$ or DMF, preferably CH$_2$Cl$_2$.

For Boc-based protocols, the successive coupling of protected amino acids may be carried out by methods well known in the art, typically in an automated peptide synthesizer. Following neutralization with triethylamine, DIEA, N-methylmorpholine (NMM), collidine, or similar base, each protected amino acid is introduced in approximately about 1.5 to 2.5 fold molar excess and the coupling carried out in an inert, nonaqueous, polar solvent such as CH$_2$Cl$_2$, DMF, N-methylpyrrolidone (NMP), N,N-dimethylacetamide (DMA), or mixtures thereof, preferably in dichloromethane at ambient temperature. For Fmoc-based protocols no acid is used for deprotection but a base, preferably DIEA or NMM, is usually incorporated into the coupling mixture. Couplings are typically done in DMF, NMP, DMA or mixed solvents, preferably DMF. Representative coupling agents are N,N'-dicyclohexylcarbodiimide (DCC), DIC or other carbodiimide, either alone or in the presence of HOBt, O-acyl ureas, benzotriazol-1-yl-oxytris(pyrrolidino)phosphonium hexafluorophosphate (PyBop), N-hydroxysuccinimide, other N-hydroxyimides, or oximes. Alternatively, protected amino acid active esters (e.g. p-nitrophenyl, pentafluorophenyl and the like) or symmetrical anhydrides may be used. Preferred coupling agents are of the aminium/uronium (alternative nomenclatures used by suppliers) class such as HBTU, O-(7-azabenzotraiazole-1-yl)-1,1,3,3-tetramethyluronium hexafluorophosphate (HATU), 2-(6-Chloro-1H-benzotriazole-1-yl)-1,1,3,3-tetramethylaminium hexafluorophosphate (HCTU), and the like.

A preferred method of attachment to the Fmoc-PAL-PEG-PS resin may be accomplished by deprotection of the resin linker with 20% piperidine in DMF, followed by reaction of the N-α-Fmoc protected amino acid, about a 5 fold molar excess of the N-α-Fmoc-amino acid, using HBTU:DIEA (1:2) in DMF in a microwave-assisted peptide synthesizer with a 5 min, 75° max coupling cycle.

For this Fmoc-based protocol in the microwave-assisted peptide synthesizer, the N-α-Fmoc amino acid protecting groups are removed with 20% piperadine in DMF containing 0.1M 1-hydroxybenzotriazole (HOBt), in a double deprotection protocol for 30 sec and then for 3 min with a temperature maximum set at 75° C. HOBt is added to the deprotection solution to reduce aspartimide formation. Coupling of the next amino acid then employs a five-fold molar excess using HBTU:DIEA (1:2) with a 5 min, 75° max. double-coupling cycle.

At the end of the solid phase synthesis the fully protected peptide is removed from the resin. When the linkage to the resin support is of the benzyl ester type, cleavage may be effected by means of aminolysis with an alkylamine or fluoroalkylamine for peptides with an alkylamide C-terminus, or by ammonolysis with, for example, ammonia/methanol or ammonia/ethanol for peptides with an unsubstituted amide C-terminus, at a temperature between about −10° and 50° C., preferably about 25° C., for between about 12 and 24 hours, preferably about 18 hours. Peptides with a hydroxy C-terminus may be cleaved by HF or other strongly acidic deprotection regimen or by saponification. Alternatively, the peptide may be removed from the resin by transesterification, e.g., with methanol, followed by aminolysis or saponification. The protected peptide may be purified by silica gel or reverse-phase HPLC.

The side chain protecting groups may be removed from the peptide by treating the aminolysis product with, for example, anhydrous liquid hydrogen fluoride in the presence of anisole or other carbonium ion scavenger, treatment with hydrogen fluoride/pyridine complex, treatment with tris (trifluoroacetyl)boron and trifluoroacetic acid, by reduction with hydrogen and palladium on carbon or polyvinylpyrrolidone, or by reduction with sodium in liquid ammonia, preferably with liquid hydrogen fluoride and anisole at a temperature between about −10° and +10° C., preferably at about 0° C., for between about 15 minutes and 2 hours, preferably about 1.5 hours.

For peptides on the benzhydrylamine type resins, the resin cleavage and deprotection steps may be combined in a single step utilizing liquid hydrogen fluoride and anisole as described above or preferably through the use of milder cleavage cocktails. For example, for the PAL-PEG-PS resin, a preferred method is through the use of a double deprotection protocol in the microwave-assisted peptide synthesizer using one of the mild cleavage cocktails known in the art, such as TFA/water/tri-iso-propylsilane/3,6-dioxa-1,8-octanedithiol (DODT) (92.5/2.5/2.5/2.5) for 18 min at 38° C. each time. Cleavage of alkyl glycoside containing materials have shown survival of the alkyl glycoside linkage using protocols with TFA/water ratios in the 9/1 to 19/1 range. A typical cocktail is 94% TFA: 2% EDT; 2% $H_2O$; 2% TIS. Typically the fully deprotected product is precipitated and washed with cold (−70° to 4° C.) diethylether, dissolved in deionized water and lyophilized.

The peptide solution may be desalted (e.g. with BioRad AG-3® anion exchange resin) and the peptide purified by a sequence of chromatographic steps employing any or all of the following types: ion exchange on a weakly basic resin in the acetate form; hydrophobic adsorption chromatography on underivatized co-poly(styrene-divinylbenzene), e.g. Amberlite® XAD; silica gel adsorption chromatography; ion exchange chromatography on carboxymethylcellulose; partition chromatography, e.g. on Sephadex® G-25; counter-current distribution; supercritical fluid chromatography; or HPLC, especially reversed-phase HPLC on octyl- or octadecylsilylsilica (ODS) bonded phase column packing.

Also provided herein are processes for preparing covalently modified peptides and/or proteins described herein and pharmaceutically acceptable salts thereof, which processes comprise sequentially condensing protected amino acids on a suitable resin support, removing the protecting groups and resin support, and purifying the product, to afford analogs of the physiologically active truncated homologs and analogs of the covalently modified peptides and/or proteins described herein. In some embodiments, covalently modified peptides and/or proteins described herein incorporate alkyl glycoside modifications as defined above.

Another aspect relates to processes for preparing covalently modified peptides and/or proteins described herein and pharmaceutically acceptable salts thereof, which processes comprise the use of microwave-assisted solid phase synthesis-based processes or standard peptide synthesis protocols to sequentially condense protected amino acids on a suitable resin support, removing the protecting groups and resin support, and purifying the product, to afford analogs of the physiologically active peptides, as defined above.

Example 3: N-Terminal endomorphin-1 analog—AcLys(1-octyl β-D-glucuronide-6-yl)endomorphin 1 (Ac-Lys(1-octyl β-D-glucuronide-6-yl)-Tyr-Pro-Trp-Phe-NH2 (AcLys(1-octyl β-D-glucuronide-6-yl) endomorphin 1)

As described above, Fmoc-Tyr(t-Bu)-Pro-Trp(Boc)-Phe-NH-Rink amide MBHA resin is prepared as described in (Koda, Y., et al. (2008) Bioorg Med Chem 16: 6286-6296). The resin is Nα-deprotected with piperadine/DMF solution, washed with solvent and coupled with 2 equivalents of N-α-Ac,N-ε-(1-octyl β-D-glucuronide-6-yl)-L-lysine using a standard coupling mixture (e.g. HBTU/DIPEA). Following completion of the coupling, the peptide is deprotected and cleaved from the resin using a deprotection mixture (95% TFA/5% $H_2O$ or DODT). The solvent is removed by a stream of nitrogen and the crude peptide is precipitated with cold $Et_2O$, collected, dissolved in 20% acetonitrile and lyophilized. Purification is by reversed phase hplc in a mobile phase containing a gradient from $H_2O$ to $H_2O$/acetonitrile using a 0.1% TFA or $NH_4OAc$ buffer system. The mixture is subjected to multiple lyophilizations from $H_2O$.

Example 4: N-Terminal endomorphin-1 analog—AcLys(1-octyl β-D-glucuronide-6-yl)endomorphin 1 (Ac-Lys(1-octyl β-D-glucuronide-6-yl)-Tyr-Pro-Trp-Phe-NH2 (AcLys(1-octyl β-D-glucuronide-6-yl) endomorphin 1)

As described above, Ac-Lys(Boc)-Tyr(t-Bu)-Pro-Trp (Boc)-Phe-NH-Rink amide MBHA resin is prepared as described in. Following completion of the synthesis, the peptide is deprotected and cleaved from the resin using a deprotection mixture (95% TFA/5% $H_2O$ or DODT). The solvent is removed by a stream of nitrogen and the crude peptide is precipitated with cold $Et_2O$, collected, dissolved in 20% acetonitrile and lyophilized. The peptide, containing a deprotected Lys ε-amino function is coupled with 2 equivalents of 1-octyl β-D-glucuronic acid using a standard coupling mixture (e.g. HBTU/DIPEA) in DMF or similar anhydrous aprotic solvent. The solvent is removed in vacuo and the product is lyophilized from 20% acetonitrile or $H_2O$. Purification is by reversed phase hplc in a mobile phase containing a gradient from $H_2O$ to $H_2O$/acetonitrile using a 0.1% TFA or $NH_4OAc$ buffer system. The mixture is subjected to multiple lyophilizations from $H_2O$.

Example 5: 2',6'-dimethyl-L-tyrosyl-prolyl-2',4',6'-trimethyl-L-phenylalanyl-Nε-(1'-octyl β-D-glucuronyl)-L-lysine amide (EU-A102)

A 0.3 mmol sample of Fmoc-Rink-Amide resin (0.5 mmol/g) was coupled with the following sequence of amino acids using a standard DIC/HOBt solid phase coupling protocol (3 equivalent of DIC/HOBt and amino acid): Fmoc-L-lysine(Nε-Alloc); Fmoc-2',4',6'-trimethyl-L-phenylalanine; Fmoc-L-proline; Fmoc-2',4'-dimethyl-L-tyrosine.

The sample of 2',6'-dimethyl-L-tyrosyl-prolyl-2',4',6'-trimethyl-L-phenylalanyl-Nε-(Alloc)-L-lysine amide resin was deprotected on the Lys-Nε position by incubation with $Pd(PPh_3)_4$ (0.5 eq) and DMBA (20 eq) in $DMF/CH_2Cl_2$ (1:1) overnight in the dark at room temperature. Following washing by $DMF/CH_2Cl_2$, the Lys side chain was acylated with 1'-octyl β-D-glucuronic acid (Carbosynth) in $DMF/CH_2Cl_2$ through the use of DIC/HOBt. Completion of the coupling was checked by ninhydrin and the product was washed extensively with $CH_2Cl_2$.

The product resin (0.77 g) was submitted to final deprotection and cleavage from the resin by treatment with the cleavage cocktail (94% TFA: 2% EDT; 2% $H_2O$; 2% TIS) for a period of 240 min at room temperature. The mixture was treated with $Et_2O$, to precipitate the product and washed extensively with $Et_2O$ to yield 290 mg of crude title peptide product after drying in vacuo.

Purification was carried out in two batches by reversed-phase (C18) hplc. The crude peptide was loaded on a 4.1×25 cm hplc column at a flow rate of 15 mL/min (15% organic modifier; acetic acid buffer) and eluted with a gradient from 15-45% buffer B in 60 min at 50° C. The product fraction was lyophilized to yield 100 mg of the title product peptide with a purity >96% by analytical hplc/mass spectrometry (M+1 peak=911.87). The overall synthesis yield was calculated at 18%.

In a similar manner, but using the reagents 1'-methyl β-D-glucuronic acid and 1'-dodecyl β-D-glucuronic acid, were prepared the corresponding Nε-(1'-methyl β-D-glucuronyl)-L-lysine[4] (EU-A101) and Nε-(1'-dodecyl β-D-glucuronyl)-L-lysine[4] (EUA-103) analogs of the title compound.

Analysis was done by HPLC/mass spectrometry in positive ion mode using the eluent gradients given in the table below.

| Compound Name | Position 4 Nε | Molecular Wt expected | Molecular Wt found | HPLC (min; elution) |
|---|---|---|---|---|
| EU-A101 | Me | 812.95 | 812.80 | 13.6 [a] |
| EU-A102 | n-octyl | 911.16 | 910.87 | 12.9 [b] |
| EU-A103 | n-dodecyl | 967.27 | 966.53 | 12.5 [c] |

HPLC gradients in 0.1% TFA
[a] 20 to 50% $CH_3CN$ over 30 min.
[b] 35 to 65% $CH_3CN$ over 30 min.
[c] 40 to 75% $CH_3CN$ over 20 min.
HPLC on Phenomenex Luna C18 5 micron 250 × 4.6 mm Example 6: 2',6'-dimethyl-L-tyrosyl-prolyl-2',4',6'-trimethyl-L-phenylalanyl-L-phenylalanyl-Nε-(1'-dodecyl β-D-glucuronyl)-L-lysine amide (EU-A106)

In a similar manner to that given for the solid phase synthesis and lysine side chain modification in example 5, given above, but using 1-dodecyl β-D-glucuronic acid (Milkereit, G., et al. (2004) Chem Phys Lipids 127: 47-63) for lysine Nε-acylation, was prepared the title peptide as a crude product. Following reversed phase hplc purification as above one obtains the title product as a white powder, of 96.1% purity by hplc/mass spectrometry (M+1=1114.8).

In a similar manner, but using the reagent 1'-methyl β-D-glucuronic acid, was prepared the corresponding Nε-(1'-methyl β-D-glucuronyl)-L-lysine[5] (EUA-105) analog of the title compound.

Analysis was done by HPLC/mass spectrometry in positive ion mode using the gradient eluents given in the table below.

| Compound Name | Position 5 Nε | Molecular Wt expected | Molecular Wt found | HPLC (min; elution) |
|---|---|---|---|---|
| EU-A105 | Me | 960.12 | 959.60 | 8.8 [d] |
| EU-A106 | n-dodecyl | 1114.44 | 1113.80 | 11.6 [e] |

HPLC gradients in 0.1% TFA
[d] 30 to 60% $CH_3CN$ over 20 min.
[e] 45 to 75% $CH_3CN$ over 20 min.
HPLC on Phenomenex Luna C18 5 micron 250 × 4.6 mm Example 7: 2',6'-dimethyl-L-tyrosyl-Nε-(1'-dodecyl β-D-glucuronyl)-D-lysyl-2',4',6'-trimethyl-L-phenylalanyl-L-phenylalanine-amide (EU-A108)

In a similar manner as that given in Example 6 was prepared the title peptide as a white powder of 95.8% purity by hplc/mass spectrometry (M=1017.07).

In a similar manner, but using the reagent 1'-methyl β-D-glucuronic acid, was prepared the corresponding Nε-(1'-methyl β-D-glucuronyl)-L-lysine (EU-A107) analog of the title compound.

Analysis was done by HPLC/mass spectrometry in positive ion mode using the eluent gradients given in the table below.

| Compound Name | Position 2 Nε | Molecular Wt expected | Molecular Wt found | HPLC (min; elution) |
|---|---|---|---|---|
| EU-A107 | Me | 862.01 | 862.73 | 11.6 [f] |
| EU-A108 | n-dodecyl | 1017.32 | 1017.07 | 11.9 [g] |

HPLC gradients in 0.1% TFA
[f] 25 to 55% $CH_3CN$ over 20 min.
[g] 50 to 80% $CH_3CN$ over 20 min.
HPLC on Phenomenex Luna C18 5 micron 250 × 4.6 mm Example 8: 2',6'-dimethyl-L-tyrosyl-L-1,2,3,4-tetrahydroisoquinoline-3-carbonyl-L-phenylalanyl-Nε-(1'-methyl β-D-glucuronyl)-L-lysyl-amide (EU-A178)

In a similar manner as that given in Example 6 was prepared the title peptide as a white powder of 95.5% purity by hplc/mass spectrometry (M=832.33).

In a similar manner, but using the reagent 1'-dodecyl β-D-glucuronic acid, was prepared the corresponding Nε-

(1'-dodecyl β-D-glucuronyl)-L-lysine analog (EU-A179) of the title compound. In a similar manner, but using the corresponding 1-alkyl glucuronic acid reagents are made the corresponding peptides of the invention, EU-A180, EU-A181, EU-A182, EU-A183, EU-A184, EU-A185, and the like.

Analysis was done by HPLC/mass spectrometry in positive ion mode using the eluent gradients given in the table below.

| Compound Name | Position 4 Nε | Molecular Wt expected | Molecular Wt found | HPLC (min; elution) |
|---|---|---|---|---|
| EU-A178 | Me | 832.91 | 832.33 | 11.2 [h] |
| EU-A179 | n-dodecyl | 987.23 | 986.47 | 10.7 [f] |
| EU-A180 | n-octyl | 931.12 | 930.67 | 10.1 [i] |

HPLC gradients in 0.1% TFA
[f] 25 to 55% CH$_3$CN over 20 min.
[h] 20 to 50% CH$_3$CN over 20 min.
[i] 35 to 65% CH$_3$CN over 20 min
HPLC on Phenomenex Luna C18 5 micron 250 × 4.6 mm

Example 9: 2',6'-dimethyl-L-tyrosyl-L-1,2,3,4-tetrahydroisoquinoline-3-carbonyl-L-phenylalanyl-L-phenylalanyl-Nε-(1'-methyl β-D-glucuronyl)-L-lysyl-amide (EU-A189)

In a similar manner as that given in Example 6 was prepared the title peptide as a white powder of 98.99% purity by hplc/mass spectrometry (M=979.53).

In a similar manner, but using the reagent 1'-dodecyl β-D-glucuronic acid, was prepared the corresponding Nε-(1'-dodecyl β-D-glucuronyl)-L-lysine (EU-A190) in position 5 analog of the title compound.

Analysis was done by HPLC/mass spectrometry in positive ion mode using the eluent gradients given in the table below.

| Compound Name | Position 5 Nε | Molecular Wt expected | Molecular Wt found | HPLC (min; elution) |
|---|---|---|---|---|
| EU-A189 | Me | 980.09 | 979.53 | 10.9 [e] |
| EU-A190 | n-dodecyl | 1134.41 | 1134.53 | 12.5 [e] |

HPLC gradients in 0.1% TFA
[e] 45 to 75% CH$_3$CN over 20 min.
HPLC on Phenomenex Luna C18 5 micron 250 × 4.6 mm

Example 10: Additional Analogs of the Invention

In a similar manner as that given in Example 6, but using the corresponding 1-alkyl β-D-glucuronic acid reagent are prepared the additional peptides of the invention as white powders of greater than 95% purity by hplc/mass spectrometry.

Analysis is done by HPLC/mass spectrometry in positive ion mode using the appropriate eluent gradients such as those given in the table below.

| Compound Name | Position 3 or 4 Nε | Molecular Wt expected | Molecular Wt found | HPLC (min; elution) |
|---|---|---|---|---|
| EU-A600 | Me | 918.02 | 918.00 | 10.7 [h] |
| EU-A601 | n-octyl | 1016.23 | 1015.87 | 10.1 [i] |
| EU-A615 | Me | 832.91 | 832.67 | 11.0 [h] |
| EU-A620 | Me | 923.06 | 922.73 | 9.5 [d] |
| EU-A639 | Me | 923.06 | 922.80 | 11.5 [f] |

HPLC gradients in 0.1% TFA
[d] 30 to 60% CH$_3$CN over 20 min.
[e.] 45 to 75% CH$_3$CN over 20 min.
[h] 20 to 50% CH$_3$CN over 20 min.
[f] 25 to 55% CH$_3$CN over 20 min.
[i] 35 to 65% CH$_3$CN over 20 min
HPLC on Phenomenex Luna C18 5 micron 250 × 4.6 mm

Example 11: General Oxidation Method for Uronic Acids

To a solution of 1-dodecyl β-D-glucopyranoside (Carbosynth) [2.0 g, 5.74 mmol] in 20 mL of acetonitrile and 20 mL of DI water was added (diacetoxyiodo)benzene (Fluka) [4.4 g, 13.7 mmol] and TEMPO (SigmaAldrich) [0.180 g, 1.15 mmol]. The resulting mixture was stirred at room temperature for 20 h. The reaction was followed by mass spectrometry (for example LCQ ESI) and upon completion, the reaction mixture was diluted with water and lyophilized to dryness to give 1.52 g (crude yield 73.1%) of the crude product, 1-dodecyl β-D-glucuronic acid, as a white powder, which was used directly for the solid phase synthesis without further purification. In a like manner, but using the corresponding 1-tetradecyl, 1-hexadecyl, and 1-octadecyl β-D-glucopyranosides (purchased from Anatrace, Maumee, Ohio) were prepared the desired alkyl saccharide uronic acids used to make the products and reagents described herein. This product was previously prepared by an alternative process using NaOCl as oxidant and also has been used for longer alkyl groups. For longer alkyl groups 1,4-dioxane was used instead of acetonitrile and the temperature was raised as high as 30° C.

In a like manner, but using, for example, the corresponding 1-octyl, 1-decyl, 1-undecyl, 1-tetradecyl, 1-hexadecyl, and 1-octadecyl glycosides (purchased from Anatrace, Maumee, Ohio) were prepared the desired 1-alkyl saccharide uronic acids which were used to make the products and reagents described herein. In a like manner, but using, for example, the corresponding 1-octyl, 1-decyl, 1-undecyl, 1-tetradecyl, 1-hexadecyl, and 1-octadecyl β-D-melibiosides or β-D-maltosides (purchased from Anatrace, Maumee, Ohio) were prepared the desired 1-alkyl disaccharide uronic acids which were used to make the products and reagents described herein. In each case the corresponding alpha glycosides can be treated similarly.

Example 12: Cellular Assay of the Compounds

Compounds were weighed precisely in an amount of approximately 2 mg and assayed in standard cellular assays by the contract research organization Cerep, Inc. (Pullman, Wash.) as executed at their subsidiary, Cerep SA (Le Bois l'Eveque, France). The readout is the amount of cAMP generated in the cells treated with the test compounds, in either agonist or antagonist mode. The assays used were the mu opioid receptor cellular assay (MOP in agonist and antagonist mode), the delta2 opioid receptor cellular assay (DOP in agonist and antagonist mode) and the kappa opioid receptor cellular assay (KOP in agonist and antagonist mode). The assays used are described in Wang, J. B., et al. (1994) FEBS Lett 338: 217-222, Law, P. Y. and Loh, H. H.

(1993) Mol Pharmacol 43: 684-693, and Avidor-Reiss, T., et al. (1995) FEBS Lett 361: 70-74. The stimulant for the cells in the DOR antagonist assay was 3×10E-8M DPDPE, a well-accepted DOR literature standard.

For the series of compounds EU-A101 to EU-A103, where the hydrophobic portion of the surfactant (1-alkyl glucuronic acid) varies in length from C1 to C12, the character of the receptor selectivity and activation (see below) varies from full agonist (C1) to pure antagonist (C12). No activity was seen in cells used for DOP or KOP assays, thus showing selectivity for the mu opioid receptor as agonists. This behavior demonstrates the ability of the modifications described herein to vary the fundamental properties of the receptor interactions. Modifications elsewhere in the molecule (e.g., using amino acid analogs) are used to further modify the potency and character of the interaction of the drug candidates.

| Compound Name | Structure | MOP agonist $EC_{50}$ (nM) | MOP antagonist $IC_{50}$ (nM) | Characterization |
|---|---|---|---|---|
| EU-A101 | Me | 13 | nc | pure agonist |
| EU-A102 | n-octyl | 100 | 100 | partial agonist |
| EU-A103 | n-dodecyl | nc | 86 | pure antagonist |
| EU-A107 | Me | 60 | nc | Agonist |

DOP antagonistic activity was assessed by inhibition of the stimulatory cAMP response of 3×10E-8M DPDPE.

| Compound Name | Structure | MOP agonist $EC_{50}$ (nM) | DOP antagonist $IC_{50}$ (M) | Characterization |
|---|---|---|---|---|
| EU-A178 | Me | 15 | <10E-10 | Pure MOP Ag; pure DOP antag |
| EU-A179 | n-dodecyl | § | NT | Pure MOP Ag; pure DOP antag |
| EU-A180 | n-octyl | 36 | <10E-10 | Pure MOP Ag; pure DOP antag |
| EU-A189 | Me | 41 | NT | Pure MOP Ag; pure DOP antag |
| EU-A190 | n-dodecyl | § | NT | Pure MOP Ag; pure DOP antag |
| EU-A600 | Me | 110 | <10E-10 | Pure MOP Ag; pure DOP antag |
| EU-A601 | n-octyl | § | <10E-10 | Pure MOP Ag; pure DOP antag |
| EU-A615 | Me | 410 | 3.1E-10 | Pure MOP Ag; pure DOP antag |
| EU-A620 | Me | 480 | <10E-10 | Pure MOP Ag; pure DOP antag |
| EU-A639 | Me | 280 | <10E-10 | Pure MOP Ag; pure DOP antag |

§ indicates solubility issues during dissolution,
NT means not tested, nc means not calculable

Example 13: In Vivo Assay of the Compounds

λ-Carrageenan-Induced Inflammatory Pain Model:

Adult male Sprague-Dawley rats were briefly anesthetized with isoflurane, and unilateral hind paw inflammatory pain was induced by injecting 3.5 g/100 µl of λ-carrageenan. A λ-carrageenan injection into the left hind paw produces redness and edema. These alterations were observed within 6 h after induction of inflammation and peaked by 24 h. Further, the changes were confined to the carrageenan treated paw. Paired t test showed a significant increase in paw volume ($p<0.0001$) and decrease in paw pressure threshold ($p<0.001$) following carrageenan treatment.

Changes in Paw Pressure Thresholds (PPT), a measurement of nociception and antinociception, was evaluated using a digital Randall-Selitto method. Briefly, animals are gently restrained and incremental pressure (maximum 350 g) was applied onto the dorsal surface of the hindpaw. The pressure required to elicit paw withdrawal, PPT, was determined. Paw-thickness, the indicator of inflammation, was measured using digital calipers. 24 h after induction of inflammation, rats received either saline, positive controls (DAMGO (8-32 µg) or fentanyl (0.4-0.8 µg)) or test peptides in 100 µl volume i.pl. The antinociception was measured at different time points (5 to 120 min or 5 hr to 24 hr) after drug administration. Baseline measures were taken before administering drug to confirm the development of inflammation and nociception. Eu-A178, for example, showed statistically significant increases in PPT beyond 30 min.

Example 14: Uses of the Compounds

The covalently modified peptides and/or proteins described herein are useful for the prevention and treatment of a variety of diseases depending on which class is being considered. For example, covalently modified peptides and/or proteins described herein are indicated for the prophylaxis and therapeutic treatment of chronic and acute pain and other MOR- or DOR-related disease states. Applications for sunburn, pruritus, cancer, immune function, inflammation, cardiovascular disease also have been documented (Lazarus, L. H., et al. (2012) Expert Opin Ther Patents 22: 1-14).

Representative delivery regimens include oral, parenteral (including subcutaneous, intramuscular and intravenous injection), rectal, buccal (including sublingual), transdermal, inhalation ocular and intranasal. An attractive and widely used method for delivery of peptides entails subcutaneous injection of a controlled release injectable formulation. Other administration routes for the application of the covalently modified peptides and/or proteins described herein are oral, subcutaneous, intranasal and inhalation administration.

Example 15: Pharmaceutical Usage for Treatment of Pain

A human patient with acute or chronic pain is treated with EU-A178 by intranasal administration (200 µL) from a standard atomizer used in the art of a solution of the pharmaceutical agent in physiological saline containing from 0.5 to 10 mg/mL of the pharmaceutical agent and containing standard excipients such as benzyl alcohol. The treatment is repeated as necessary for the alleviation of pain. Alternatively a solution of EU-A178, and selected excipients, in an evaporating solvent containing such as a hydrofluoroalkane is administered intranasally by MDI as needed to alleviate pain. Alternatively an aqueous solution of EU-A178, with selected excipients, is administered by subcutaneous injection as needed to alleviate pain.

The effect of treatment is determined from evaluation of patients, including quality of life questionaires. Pain scales are based on self-report, observational (behavioral), or physiological data. Some pain scales suitable for use in clinical setting include Alder Hey Triage Pain Score, Brief Pain Inventory (BPI), Dallas Pain Questionnaire, Dolorimeter Pain Index (DPI), McGill Pain Questionnaire (MPQ), Numerical 11 point box (BS-11), Numeric Rating Scale (NRS-11), Roland-Morris Back Pain Questionnaire, Visual analog scale (VAS) or the like.

In a similar manner, administration of an adjusted amount by transbuccal, intravaginal, inhalation, subcutaneous, intravenous, intraocular, or oral routes is tested to determine relief from pain.

Example 2-1: Reagents—N-α-Fmoc,N-ε-(1-octyl β-D-glucuronide-6-yl)-L-lysine

In an oven-dried 250 mL Erlenmeyer flask is placed 1-octyl β-D-glucuronic acid (Carbosynth Ltd., 3.06 g, 10 mmol), 50 mL anhydrous DMF, and anhydrous 1-hydroxybenzotriazole (1.62 g, 12 mmol). A chilled (4° C.) solution of N,N'-dicyclohexylcarbodiimide (2.48 g, 12 mmol) in 50 mL of DMF is added, with stirring, and the reaction is allowed to proceed for 5 min. The copious white precipitate of N,N'-dicyclohexylurea is filtered on a fritted glass funnel and the filtrate is added to a solution of N-α-Fmoc-L-lysine (3.68 g, 10 mmol) in 25 ml anhydrous DMF. The reaction is allowed to proceed for 25 min with warming to room temp or until the ninhydrin color is very faint. The reaction mixture is filtered, stripped to dryness and crystallized from MeOH/Et$_2$O by dissolution in MeOH and slow dilution to the cloud point with Et$_2$O, followed by refrigeration. Further purification can be achieved by silica gel chromatography using a solvent gradient from EtOAc to EtOAc/EtOH/AcOH.

In a similar manner, but substituting N-α-Boc-L-lysine is obtained N-α-Boc,N-ε-(1-octyl β-D-glucuronide-6-yl)-L-lysine, suitable for N-terminal incorporation and cleavage to a free N-Terminus. In a similar manner, but substituting N-α-Ac-L-lysine is obtained N-α-Ac,N-ε-(1-octyl β-D-glucuronide-6-yl)-L-lysine, suitable for incorporation at the N-terminus of a peptide with a blocked N-terminus. In a similar manner, but substituting the appropriate amount of N-α-Fmoc-L-ornithine is obtained N-α-Fmoc,N-δ-(1-octyl β-D-glucuronide-6-yl)-L-ornithine. In a similar manner but substituting other N-mono-protected diamino acids one obtains the corresponding reagents. Alternatively, use of a transient Me$_3$Si ester protecting group during the coupling and without preactivation of the 1-octyl β-D-glucuronic acid provides a facile route to the formation of the reagents. The transient Me$_3$Si ester is produced by reaction of the Fmoc-Lys-OH with an equimolar amount of N,O-bis(trimethylsilyl)acetamide in dichloromethane (CH$_2$Cl$_2$). The organic layer contains the desired reagent as a solution in CH$_2$Cl$_2$ ready for coupling with the 1-alkyl glucoronide as above. The filtered reaction mixture is washed with aqueous NaHSO$_4$ to hydrolyze the Me$_3$Si ester, dried over MgSO$_4$ and solvent is removed.

Similarly, but using peracetyl or perbenzoyl 1-octyl β-D-glucuronic acid one obtains the Ac, or Bz protected form of the reagents (e.g. 2,3,4-trisacetyl 1-octyl β-D-glucuronic acid, and the like, formed by treatment with Ac$_2$O). Such reagents have increased stability during acid cleavage from the resin and are used when instability during deprotection is detected, see (Kihlberg, J., et al. (1997) Methods Enzymol 289: 221-245) and references therein. Final deprotection of such products is carried out by base-catalyzed transesterification after cleavage, by use of MeOH/NH$_3$, MeOH/NaOMe, MeOH/NH$_2$NH$_2$, as described above.

Example 2-2: Synthetic Peptide Analogs

In general, peptide synthesis methods involve the sequential addition of protected amino acids to a growing peptide chain. Normally, either the amino or carboxyl group of the first amino acid and any reactive side chain group are protected. This protected amino acid is then either attached to an inert solid support, or utilized in solution, and the next amino acid in the sequence, also suitably protected, is added under conditions amenable to formation of the amide linkage. After all the desired amino acids have been linked in the proper sequence, protecting groups and any solid support are removed to afford the crude peptide. The peptide is desalted and purified chromatographically.

A preferred method of preparing the analogs of the physiologically active truncated peptides, having fewer than about fifty amino acids, involves solid phase peptide synthesis. In this method the α-amino (Nα) functions and any reactive side chains are protected by acid- or base-sensitive groups. The protecting group should be stable to the conditions of peptide linkage formation, while being readily removable without affecting the extant peptide chain. Suitable α-amino protecting groups include, but are not limited to t-butyloxycarbonyl (Boc), benzyloxycarbonyl (Cbz), o-chlorobenzyloxycarbonyl, biphenylisopropyloxycarbonyl, t-amyloxycarbonyl (Amoc), isobornyloxycarbonyl, α,α-dimethyl-3,5-dimethoxybenzyloxy-carbonyl, o-nitrophenylsulfenyl, 2-cyano-t-butoxycarbonyl, 9-fluorenylmethoxycarbonyl (Fmoc) and the like, preferably Boc or more preferably, Fmoc. Suitable side chain protecting groups include, but are not limited to: acetyl, benzyl (Bzl), benzyloxymethyl (Bom), Boc, t-butyl, o-bromobenzyloxycarbonyl, t-butyl, t-butyldimethylsilyl, 2-chlorobenzyl (Cl-z), 2,6-dichlorobenzyl, cyclohexyl, cyclopentyl, isopropyl, pivalyl, tetrahydropyran-2-yl, tosyl (Tos), 2,2,4,6,7-pentamethyldihydrobenzofuran-5-sulfonyl (Pbf), trimethylsilyl and trityl. A preferred Nα-protecting group for synthesis of the compounds is the Fmoc group. Preferred side chain protecting groups are O-t-Butyl group for Glu, Tyr, Thr, Asp and Ser; Boc group for Lys and Trp side chains; Pbf group for Arg; Trt group for Asn, Gln, and His. For selective modification of a Lys residue, orthogonal protection with a protecting group not removed by reagents that cleave the Fmoc or t-butyl based protecting groups is preferred. Preferred examples for modification of the Lys side chain include, but are not limited to, those removed by hydrazine but not piperidine; for example 1-(4,4-dimethyl-2,6-dioxocyclohex-1-ylidene)-3-methylbutyl (ivDde) or 1-(4,4-dimethyl-2,6-dioxocyclohex-1-ylidene)ethyl (Dde) and allyloxycarbonyl (Alloc).

The Fmoc-Lys(ivDde) or Fmoc-Lys(Dde) protecting group scheme is preferred in cases where side chain lactam formation is desired (Houston, M. E., Jr., et al. (1995) J Pept Sci 1: 274-282; Murage, E. N., et al. (2010) J Med Chem), since in this case Fmoc-Glu(O-Allyl) and Fmoc-Lys(Alloc) can be incorporated and used to provide transient protection, then deprotected for lactam formation while the Lys(Dde) protecting group remains for later removal and reaction with the functionalized surfactant. The side chain lactam between acidic and basic residue (e.g. Glu and Lys) is carried out after removal of the allyl-based protection by activation of the carboxyl side chain function with N,N'-diisopropylcarbodiimide (DIC)/1-hydroxybenzotriazole (HOBt) or 2-(1H-benzotriazole-1-yl)-1,1,3,3-tetramethylaminium hexafluorophosphate (HBTU)/N,N-di-isopropylethylamine (DIEA), using standard protocols well known to the art.

In solid phase synthesis, the C-terminal amino acid is first attached to a suitable resin support. Suitable resin supports are those materials which are inert to the reagents and reaction conditions of the stepwise condensation and deprotection reactions, as well as being insoluble in the media used. Examples of commercially available resins include styrene/divinylbenzene resins modified with a reactive group, e.g., chloromethylated co-poly-(styrene-divinylbenzene), hydroxymethylated co-poly-(styrene-divinylbenzene), and the like. Benzylated, hydroxymethylated phenylacetamidomethyl (PAM) resin is preferred for the preparation of peptide acids. When the C-terminus of the compound is an amide, a preferred resin is p-methylbenzhydrylamino-co-poly(styrene-divinyl-benzene) resin, a 2,4 dimethoxybenzhydrylamino-based resin ("Rink amide"), 4-Hydroxymethylphenoxyacetyl aminomethyl resin (HMP Am) and the like. An especially preferred support for the synthesis of larger peptides are commercially available resins containing PEG sequences grafted onto other polymeric matrices, such as the Rink Amide-PEG and PAL-PEG-PS resins (Applied Biosystems) or similar resins designed for peptide amide synthesis using the Fmoc protocol. Thus in certain cases it is desirable to have an amide linkage to a PEG chain. It those cases it is convenient to link an N-Fmoc-amino-PEG-carboxylic acid to the amide forming resin above (e.g. Rink amide resin and the like). The first amino acid of the chain can be coupled as an N-Fmoc-amino acid to the amino function of the PEG chain. Final deprotection will yield the desired Peptide-NH-PEG-CO—$NH_2$ product.

Attachment to the PAM resin may be accomplished by reaction of the $N\alpha$ protected amino acid, for example the Boc-amino acid, as its ammonium, cesium, triethylammonium, 1,5-diazabicyclo-[5.4.0]undec-5-ene, tetramethylammonium, or similar salt in ethanol, acetonitrile, N,N-dimethylformamide (DMF), and the like, preferably the cesium salt in DMF, with the resin at an elevated temperature, for example between about 40° and 60° C., preferably about 50° C., for from about 12 to 72 hours, preferably about 48 hours. This will eventually yield the peptide acid product following acid cleavage or an amide following aminolysis.

The $N\alpha$-Boc-amino acid may be attached to the benzhydrylamine or HPM Am resin by means of, for example, an N,N'-diisopropylcarbodiimide (DIC)/1-hydroxybenzotriazole (HOBt) mediated coupling for from about 2 to about 24 hours, preferably about 2 hours at a temperature of between about 10° and 50° C., preferably 25° C. in a solvent such as $CH_2Cl_2$ or DMF, preferably $CH_2Cl_2$.

For Boc-based protocols, the successive coupling of protected amino acids may be carried out by methods well known in the art, typically in an automated peptide synthesizer. Following neutralization with triethylamine, N,N-diisopropylethylamine (DIEA), N-methylmorpholine (NMM), collidine, or similar base, each protected amino acid is introduced in approximately about 1.5 to 2.5 fold molar excess and the coupling carried out in an inert, nonaqueous, polar solvent such as $CH_2Cl_2$, DMF, N-methylpyrrolidone (NMP), N,N-dimethylacetamide (DMA), or mixtures thereof, preferably in dichloromethane at ambient temperature. For Fmoc-based protocols no acid is used for deprotection but a base, preferably DIEA or NMM, is usually incorporated into the coupling mixture. Couplings are typically done in DMF, NMP, DMA or mixed solvents, preferably DMF. Representative coupling agents are N,N'-dicyclohexylcarbodiimide (DCC), N,N'-diisopropylcarbodiimide (DIC) or other carbodiimide, either alone or in the presence of HOBt, O-acyl ureas, benzotriazol-1-yloxytris(pyrrolidino)phosphonium hexafluorophosphate (Py-Bop), N-hydroxysuccinimide, other N-hydroxyimides, or oximes. Alternatively, protected amino acid active esters (e.g. p-nitrophenyl, pentafluorophenyl and the like) or symmetrical anhydrides may be used. Preferred coupling agents are of the aminium/uronium (alternative nomenclatures used by suppliers) class such as 2-(1H-benzotriazole-1-yl)-1,1,3, 3-tetramethylaminium hexafluorophosphate (HBTU), O-(7-azabenzotraiazole-1-yl)-1,1,3,3-tetramethyluronium hexafluorophosphate (HATU), 2-(6-Chloro-1H-benzotriazole-1-yl)-1,1,3,3-tetramethylaminium hexafluorophosphate (HCTU), and the like.

A preferred method of attachment to the Fmoc-PAL-PEG-PS resin may be accomplished by deprotection of the resin linker with 20% piperidine in DMF, followed by reaction of the N-α-Fmoc protected amino acid, about a 5 fold molar excess of the N-α-Fmoc-amino acid, using HBTU:di-isopropylethylamine (DIEA) (1:2) in DMF in a microwave-assisted peptide synthesizer with a 5 min, 75° max coupling cycle.

For this Fmoc-based protocol in the microwave-assisted peptide synthesizer, the N-α-Fmoc amino acid protecting groups are removed with 20% piperidine in DMF containing 0.1M 1-hydroxybenzotriazole (HOBt), in a double deprotection protocol for 30 sec and then for 3 min with a temperature maximum set at 75° C. HOBt is added to the deprotection solution to reduce aspartimide formation. Coupling of the next amino acid then employs a five-fold molar excess using HBTU:DIEA (1:2) with a 5 min, 75° max. double-coupling cycle.

At the end of the solid phase synthesis the fully protected peptide is removed from the resin. When the linkage to the resin support is of the benzyl ester type, cleavage may be effected by means of aminolysis with an alkylamine or fluoroalkylamine for peptides with an alkylamide C-terminus, or by ammonolysis with, for example, ammonia/methanol or ammonia/ethanol for peptides with an unsubstituted amide C-terminus, at a temperature between about −10° and 50° C., preferably about 25° C., for between about 12 and 24 hours, preferably about 18 hours. Peptides with a hydroxy C-terminus may be cleaved by HF or other strongly acidic deprotection regimen or by saponification. Alternatively, the peptide may be removed from the resin by transesterification, e.g., with methanol, followed by aminolysis or saponification. The protected peptide may be purified by silica gel or reverse-phase HPLC.

The side chain protecting groups may be removed from the peptide by treating the aminolysis product with, for example, anhydrous liquid hydrogen fluoride in the presence of anisole or other carbonium ion scavenger, treatment with hydrogen fluoride/pyridine complex, treatment with tris (trifluoroacetyl)boron and trifluoroacetic acid, by reduction with hydrogen and palladium on carbon or polyvinylpyrrolidone, or by reduction with sodium in liquid ammonia, preferably with liquid hydrogen fluoride and anisole at a temperature between about −10° and +10° C., preferably at about 0° C., for between about 15 minutes and 2 hours, preferably about 1.5 hours.

For peptides on the benzhydrylamine type resins, the resin cleavage and deprotection steps may be combined in a single step utilizing liquid hydrogen fluoride and anisole as described above or preferably through the use of milder cleavage cocktails. For example, for the PAL-PEG-PS resin, a preferred method is through the use of a double deprotection protocol in the microwave-assisted peptide synthesizer using one of the mild cleavage cocktails known in the art, such as TFA/water/tri-iso-propylsilane/3,6-dioxa-1,8-octanedithiol (DODT) (92.5/2.5/2.5/2.5) for 18 min at 38° C. each time. Cleavage of alkyl glycoside containing materials have shown survival of the alkyl glycoside linkage using protocols with TFA/water ratios in the 9/1 to 19/1 range. A typical cocktail is 94% TFA: 2% EDT; 2% $H_2O$; 2% TIS. Typically the fully deprotected product is precipitated and washed with cold (−70° to 4° C.) Et₂O, dissolved in deionized water and lyophilized.

The peptide solution may be desalted (e.g. with BioRad AG-3® anion exchange resin) and the peptide purified by a sequence of chromatographic steps employing any or all of the following types: ion exchange on a weakly basic resin in the acetate form; hydrophobic adsorption chromatography on underivatized co-poly(styrene-divinylbenzene), e.g. Amberlite® XAD; silica gel adsorption chromatography; ion exchange chromatography on carboxymethylcellulose; partition chromatography, e.g. on Sephadex® G-25; counter-current distribution; supercritical fluid chromatography; or HPLC, especially reversed-phase HPLC on octyl- or octadecylsilylsilica (ODS) bonded phase column packing.

Also provided herein are processes for preparing covalently modified peptides and/or proteins described herein and pharmaceutically acceptable salts thereof, which processes comprise sequentially condensing protected amino acids on a suitable resin support, removing the protecting groups and resin support, and purifying the product, to afford analogs of the physiologically active truncated homologs and analogs of the covalently modified peptides and/or proteins described herein. In some embodiments, covalently modified peptides and/or proteins described herein incorporate alkyl glycoside modifications as defined above.

Another aspect relates to processes for preparing covalently modified peptides and/or proteins described herein and pharmaceutically acceptable salts thereof, which processes comprise the use of microwave-assisted solid phase synthesis-based processes or standard peptide synthesis protocols to sequentially condense protected amino acids on a suitable resin support, removing the protecting groups and resin support, and purifying the product, to afford analogs of the physiologically active peptides, as defined above.

Example 2-3: General Oxidation Method for Uronic Acids

To a solution of 1-dodecyl β-D-glucopyranoside (Carbosynth) [2.0 g, 5.74 mmol] in 20 mL of acetonitrile and 20 mL of DI water was added (diacetoxyiodo)benzene (Fluka) [4.4 g, 13.7 mmol] and TEMPO (SigmaAldrich) [0.180 g, 1.15 mmol]. The resulting mixture was stirred at room temperature for 20 h. The reaction was followed by mass spectrometry (for example LCQ ESI) and upon completion, the reaction mixture was diluted with water and lyophilized to dryness to give 1.52 g (crude yield 73.1%) of the crude product, 1-dodecyl β-D-glucuronic acid, as a white powder, which was used directly for the solid phase synthesis without further purification. This product was previously prepared by an alternative process using NaOCl as oxidant, as described in the specification, and also has been used for longer alkyl groups. In a like manner, but using the corresponding 1-tetradecyl, 1-hexadecyl, and 1-octadecyl β-D-glucopyranosides (purchased from Anatrace, Maumee, Ohio) were prepared the desired alkyl saccharide uronic acids used to make the products and reagents described herein. For longer alkyl groups 1,4-dioxane was used instead of acetonitrile and the temperature was raised as high as 30° C.

In a like manner, but using, for example, the corresponding 1-octyl, 1-decyl, 1-undecyl, 1-tetradecyl, 1-hexadecyl, and 1-octadecyl glycosides (purchased from Anatrace, Maumee, Ohio) were prepared the desired 1-alkyl saccharide uronic acids which were used to make the products and reagents described herein. In a like manner, but using, for example, the corresponding 1-octyl, 1-decyl, 1-undecyl, 1-tetradecyl, 1-hexadecyl, and 1-octadecyl β-D-melibiosides or β-D-maltosides (purchased from Anatrace, Maumee, Ohio) were prepared the desired 1-alkyl disaccharide uronic acids which were used to make the products and reagents described herein. In each case the corresponding alpha glycosides can be treated similarly.

Example 2-4: Preparation of PTHrP Analog EU-204

A sample of Fmoc-Ac5c-Val-Aib-Glu-Ile-Gln-Leu-Nle-His-Gln-Arg-Ala-Arg-Trp-Ile-Gln-Lys(Alloc)-Rink amide resin was deprotected on the Lys-N-epsilon position by incubation with Pd(PPh3)4 (0.5 eq) and DMBA (20 eq) in DMF/CH₂Cl₂ (1:1) overnight in the dark at room temperature. Following washing by DMF/CH₂Cl₂, the Lys side chain was acylated with 1'-octyl dodecyl β-D-glucuronic acid (Carbosynth) in DMF/CH₂Cl₂ through the use of DIC/HOBt. Completion of the coupling was checked by ninhydrin and the product was washed extensively with CH₂Cl₂.

The product resin was submitted to final deprotection and cleavage from the resin by treatment with the cleavage cocktail (94% TFA: 2% EDT; 2% H₂O; 2% TIS) for a period of 240 min at room temperature. The mixture was treated with Et₂O, to precipitate the product and washed extensively with Et₂O to yield the crude title peptide product after drying in vacuo.

Purification was carried out in two batches by reversed phase (C18) hplc. The crude peptide was loaded on a 4.1×25 cm hplc column at a flow rate of 15 mL/min (15% organic modifier; acetic acid buffer) and eluted with a gradient from 15-45% buffer B in 60 min at 50° C. The product fraction was lyophilized to yield the title product peptide with a purity >97% by analytical hplc (12.0 min; 35-65% CH₃CN in 0.1% TFA)/mass spectrometry (M+1 peak=2473.9).

The corresponding 1-methyl, 1-octyl, 1-decyl, 1-dodecyl, 1-tetradecyl, 1-hexadecyl, 1-octadecyl and 1-eicosyl analogs are prepared using the corresponding glucouronic acids, prepared as described above. Alternatively, the 1-alkyl glucuronyl, or other uronic acylated analogs, may be prepared by initial purification of the deprotected or partially deprotected peptide followed by acylation by the desired uronic acid reagent.

Analysis was done by HPLC/mass spectrometry in positive ion mode using the eluent gradients given in the table below.

| Compound Name | Molecular Wt expected | Molecular Wt found | HPLC (min; elution) |
| --- | --- | --- | --- |
| EU-201 | 2278.63 | 2278.14 | 14.1 [a] |
| EU-202 | 2376.86 | 2376.80 | 11.2 [b] |
| EU-203 | 2432.97 | 2432.40 | 14.1 [c] |
| EU-204 | 2472.00 | 2471.86 | 12.0 [d] |
| EU-205 | 2343.87 | 2344.26 | 8.0 [e] |
| EU-207 | 2557.12 | 2557.06 | 13.2 [c] |
| EU-232 | 2642.23 | 2642.14 | 12.6 [c] |
| EU-251 | 2941.56 | 2942.26 | 13.1 [c] |
| EU-260 | 2967.61 | 2966.66 | 13.9 [c] |
| EU-283 | 2881.47 | 2882.26 | 11.0 [c] |
| EU-284 | 3640.39 | 3640.00 | 11.9 [c] |
| EU-286 | 2670.47 | 2669.86 | 6.3 [e] |

-continued

| Compound Name | Molecular Wt expected | Molecular Wt found | HPLC (min; elution) |
|---|---|---|---|
| EU-287 | 2698.47 | 2697.74 | 8.4 [e] |
| EU-288 | 2726.47 | 2726.26 | 10.9 [f] |

HPLC gradients in 0.1% TFA
[a] 20 to 50% $CH_3CN$ over 30 min.
[b] 25 to 55% $CH_3CN$ over 20 min.
[c] 30 to 60% $CH_3CN$ over 20 min.
[d] 35 to 65% $CH_3CN$ over 20 min.
[e] 40 to 70% $CH_3CN$ over 20 min.
[f] 45 to 75% $CH_3CN$ over 20 min.
HPLC on Phenomenex Luna C18 5 micron 250 × 4.6 mm.

Example 2-5: Cellular Assay of the Compounds

Compounds were weighed precisely in an amount of approximately 1 mg and assayed in standard cellular assays (cerep SA). The readout is the amount of cAMP generated in the cells treated with the test compounds, in either agonist or antagonist mode. The PTH1 cellular assay used is described in Orloff, J. J., et al. (1992) Endocrinol 131: 1603-1611.

For the series of compounds EU-201 to EU-203, where the hydrophobic portion of the surfactant (1-alkyl glucuronic acid) varies in length from C1 to C12, the cellular response increases in potency and efficacy with the increased chain length. All of the analogs were agonists. Further substitutions led to molecules with an $EC_{50}$ similar to PTH1-34, but with super-agonistic activity (e.g. EU-232) and such molecules have important applications in medicine. Additional analogs are designed to have very prolonged duration of action in vivo (that is EU-286, EU-287, and EU-288). In this assay, PTHrP (coded sample) had an EC50 of 2.9 nM and a maximal response of 100% while the internal standard, PTH had EC50 of 1.4 nM and maximal response of 105%. Compounds were dissolved in water and diluted in assay buffer containing 1% bovine serum albumin. The following table shows potency and efficacy of certain peptide products described herein.

| Compound Name | Structure | EC50 (nM) | Maximal response (% PTHrP) | Characterization |
|---|---|---|---|---|
| EU-201 | 1-Me | 40 | 115 | agonist |
| EU-202 | 1-octyl | 25 | 118 | agonist |
| EU-203 | 1-dodecyl | 25 | 129 | agonist |
| EU-204 | 1-dodecyl | 20 | 135 | agonist |
| EU-205 | 1-dodecyl | 40 | 115 | agonist |
| EU-207 | 1-dodecyl | 40 | 110 | agonist |
| EU-232 | 1-dodecyl | 2.4 | 145 | agonist |
| EU-251 | 1-dodecyl | 4.3 | 135 | agonist |
| EU-260 | 1-dodecyl | 2.2 | 120 | agonist |
| EU-283 | 1-dodecyl | 5.2 | 100 | agonist |
| EU-284 | 1-dodecyl | 62 | 110 | agonist |
| EU-287 | 1-hexadecyl | <1 | 128 | agonist |
| EU-288 | 1-octadecyl | <1 | 130 | agonist |

When tested in antagonist mode, with added PTHrP, the maximal effects were even greater (to 146% of PTHrP maximal for the C-12 compound, EU-203). This behavior demonstrates the ability of the modification described herein to vary the fundamental properties of the receptor interactions. Modifications elsewhere in the molecule can be used to further modify the potency and character of the interaction of the drug candidates.

Example 2-6: In Vivo Assay of the Compounds

Following the method of Frolik, C. A., et al. (2003) Bone 33: 372-379, 20 male rats from Sino-British SIPPR/BK Lab Animal Ltd were acclimated to standard laboratory conditions for a period of 7 days. After acclimation, the animals were sorted by age into groups of 5. Each animal in a group was treated with a single sc injection of either vehicle or test agent.

Animals in two test groups were treated with 80 mcg/animal of huPTH1-34 (Bachem) or 80 mcg/animal of EU-232. A fourth group was treated with EU-232 at 320 mcg/animal. Blood samples were collected via retro-orbital vein at 0.5, 1, 2, 4, and 5 hrs. post-injection and blood samples were stored on ice prior to centrifugation and testing for blood $PO_4$ and Ca levels.

In the 80 mcg groups (PTH and EU-232) there was a transient but not statistically significant decrease in blood $PO_4$ levels in response to PTH or EU-232 and $PO_4$ levels did not further diminish after 1 hour. In response to treatment with EU-232, the blood $PO_4$ levels decreased to statistically significantly lower levels with time and the maximal decrease (25-35% decrease from time 0 hr. level) was seen at the 5 hr. time point indicating a potent and prolonged duration of action for EU-232. No groups showed a statistically different blood Ca level compared to vehicle at any time point, thus there was no indication of a propensity for hypercalcemia following dosing.

In a similar manner, the analogs described herein (including compounds of Table 1 in FIG. 1) are tested to evaluate their potency and duration of action in vivo.

The covalently modified peptides and/or proteins described herein are useful for the prevention and treatment of a variety of diseases. PTHR1 agonists are effective in the treatment of bone density diseases such as postmenopausal or senile osteoporosis, hypoparathroidism, osteopenia, implant fixation, and certain metastatic tumors. Antagonistic analogs are suitable for treatment of hypercalcemia, especially as related to hyperparathyroidism or hypercalcemia of malignancy. PTH and PTHrP agonists can be used to mobilize proliferation of haematopoietic stem cells (HSC) in bone marrow in vivo or in vitro for use in bone marrow transplant and in disease syndromes related to low blood cell concentrations. Expansion post-transplant is an attractive application as well. Since many cells in the blood originate from HSCs, a wide range of applications is possible. Suitably labeled surfactant modified peptides can be used as diagnostic probes.

Representative delivery regimens include oral, parenteral (including subcutaneous, intramuscular and intravenous injection), rectal, buccal (including sublingual), transdermal, inhalation ocular and intranasal. An attractive and widely used method for delivery of peptides entails subcutaneous injection of a controlled release injectable formulation. Other administration routes for the application of the covalently modified peptides and/or proteins described herein are subcutaneous, intranasal and inhalation administration.

Example 2-7: Pharmaceutical Usage for Treatment of Osteoporosis

A human patient, with evidence of osteoporosis or osteopenia is treated with EU-204 by intranasal administration (200 µL) from a standard atomizer used in the art of a solution of the pharmaceutical agent in physiological saline containing from 0.5 to 10 mg/mL of the pharmaceutical agent and containing standard excipients such as benzyl alcohol. The treatment is repeated as necessary for the alleviation of symptoms such as bone pain, osteopenia, low bone density, or fractures. In a similar manner, a solution of EU-204, and selected excipients, in an evaporating solvent containing such as a hydrofluoroalkane is administered intranasally by metered dose inhaler (MDI) as needed to stimulate bone accretion. The effect of treatment is measured by use of standard tests, including the Bone Mineral Density test (BMD test).

All of the compounds described in Table 1 of FIG. 1 are tested using a similar protocol.

In a similar manner, administration of an adjusted amount by transbuccal, intravaginal, inhalation, subcutaneous, intravenous, intraocular, or oral routes is tested to determine the level of stimulation of PTHR1 on cells in the body, and to determine therapeutic effects.

Example 3-1: Reagents—N-α-Fmoc,N-ε-(1-octyl β-D-glucuronide-6-yl)-L-lysine

In an oven-dried 250 mL Erlenmeyer flask is placed 1-octyl β-D-glucuronic acid (Carbosynth Ltd., 3.06 g, 10 mmol), 50 mL anhydrous DMF, and anhydrous 1-hydroxybenzotriazole (1.62 g, 12 mmol). A chilled (4° C.) solution of N,N'-dicyclohexylcarbodiimide (2.48 g, 12 mmol) in 50 mL of DMF is added, with stirring, and the reaction is allowed to proceed for 5 min. The copious white precipitate of N,N'-dicyclohexylurea is filtered on a fritted glass funnel and the filtrate is added to a solution of N-α-Fmoc-L-lysine (3.68 g, 10 mmol) in 25 ml anhydrous DMF. The reaction is allowed to proceed for 25 min with warming to room temp or until the ninhydrin color is very faint. The reaction mixture is filtered, stripped to dryness and crystallized from MeOH/Et$_2$O by dissolution in MeOH and slow dilution to the cloud point with Et$_2$O, followed by refrigeration. Further purification can be achieved by silica gel chromatography using a solvent gradient from EtOAc to EtOAc/EtOH/AcOH.

In a similar manner, but substituting N-α-Boc-L-lysine is obtained N-α-Boc,N-ε-(1-octyl β-D-glucuronide-6-yl)-L-lysine, suitable for N-terminal incorporation and cleavage to a free N-Terminus. In a similar manner, but substituting N-α-Ac-L-lysine is obtained N-α-Ac,N-ε-(1-octyl β-D-glucuronide-6-yl)-L-lysine, suitable for incorporation at the N-terminus of a peptide with a blocked N-terminus. In a similar manner, but substituting the appropriate amount of N-α-Fmoc-L-ornithine is obtained N-α-Fmoc,N-δ-(1-octyl β-D-glucuronide-6-yl)-L-ornithine. In a similar manner but substituting other N-mono-protected diamino acids one obtains the corresponding reagents. Alternatively, use of a transient Me$_3$Si ester protecting group during the coupling and without preactivation of the 1-octyl β-D-glucuronic acid provides a facile route to the formation of the reagents. The transient Me$_3$Si ester is produced by reaction of the Fmoc-Lys-OH with an equimolar amount of N,O-bis(trimethylsilyl)acetamide in dichloromethane (CH$_2$Cl$_2$). The organic layer contains the desired reagent as a solution in CH$_2$Cl$_2$ ready for coupling with the 1-alkyl glucoronide as above. The filtered reaction mixture is washed with aqueous NaHSO$_4$ to hydrolyze the Me$_3$Si ester, dried over MgSO$_4$ and solvent is removed.

Similarly, but using peracetyl or perbenzoyl 1-octyl β-D-glucuronic acid one obtains the Ac, or Bz protected form of the reagents (e.g. 2,3,4-trisacetyl 1-octyl β-D-glucuronic acid, and the like, formed by treatment with Ac$_2$O). Such reagents have increased stability during acid cleavage from the resin and are used when instability during deprotection is detected, see (Kihlberg, J., et al. (1997) Methods Enzymol 289: 221-245) and references therein. Final deprotection of such products is carried out by base-catalyzed transesterification after cleavage, by use of MeOH/NH$_3$, MeOH/NaOMe, MeOH/NH$_2$NH$_2$, as described above.

Example 3-2: Synthetic Peptide Analogs

In general, peptide synthesis methods involve the sequential addition of protected amino acids to a growing peptide chain. Normally, either the amino or carboxyl group of the first amino acid and any reactive side chain group are protected. This protected amino acid is then either attached to an inert solid support, or utilized in solution, and the next amino acid in the sequence, also suitably protected, is added under conditions amenable to formation of the amide linkage. After all the desired amino acids have been linked in the proper sequence, protecting groups and any solid support are removed to afford the crude peptide. The peptide is desalted and purified chromatographically.

A preferred method of preparing the analogs of the physiologically active truncated peptides, having fewer than about fifty amino acids, involves solid phase peptide synthesis. In this method the α-amino (Nα) functions and any reactive side chains are protected by acid- or base-sensitive groups. The protecting group should be stable to the conditions of peptide linkage formation, while being readily removable without affecting the extant peptide chain. Suitable α-amino protecting groups include, but are not limited to t-butyloxycarbonyl (Boc), benzyloxycarbonyl (Cbz), o-chlorobenzyloxycarbonyl, biphenylisopropyloxycarbonyl, t-amyloxycarbonyl (Amoc), isobornyloxycarbonyl, α,α-dimethyl-3,5-dimethoxybenzyloxy-carbonyl, o-nitrophenylsulfenyl, 2-cyano-t-butoxycarbonyl, 9-fluorenylmethoxycarbonyl (Fmoc) and the like, preferably Boc or more preferably, Fmoc. Suitable side chain protecting groups include, but are not limited to: acetyl, benzyl (Bzl), benzyloxymethyl (Bom), Boc, t-butyl, o-bromobenzyloxycarbonyl, t-butyl, t-butyldimethylsilyl, 2-chlorobenzyl (Cl-z), 2,6-dichlorobenzyl, cyclohexyl, cyclopentyl, isopropyl, pivalyl, tetrahydropyran-2-yl, tosyl (Tos), 2,2,4,6,7-pentamethyldihydrobenzofuran-5-sulfonyl (Pbf), trimethylsilyl and trityl. A preferred Nα-protecting group for synthesis of the compounds is the Fmoc group. Preferred side chain protecting groups are O-t-Butyl group for Glu, Tyr, Thr, Asp and Ser; Boc group for Lys and Trp side chains; Pbf group for Arg; Trt group for Asn, Gln, and His. For selective modification of a Lys residue, orthogonal protection with a protecting group not removed by reagents that cleave the Fmoc or t-butyl based protecting groups is preferred. Preferred examples for modification of the Lys side chain include, but are not limited to, those removed by hydrazine but not piperidine; for example 1-(4,4-dimethyl-2,6-dioxocyclohex-1-ylidene)-3-methylbutyl (ivDde) or 1-(4,4-dimethyl-2,6-dioxocyclohex-1-ylidene)ethyl (Dde) and allyloxycarbonyl (Alloc). The Fmoc-Lys(ivDde) or Fmoc-Lys (Dde) protecting group scheme is preferred in cases where side chain lactam formation is desired (Houston, M. E., Jr., et al. (1995) J Pept Sci 1: 274-282; Murage, E. N., et al. (2010) J Med Chem), since in this case Fmoc-Glu(O-Allyl) and Fmoc-Lys(Alloc) can be incorporated and used to provide transient protection, then deprotected for lactam formation while the Lys(Dde) protecting group remains for later removal and reaction with the functionalized surfactant.

The Fmoc-Lys(ivDde) or Fmoc-Lys(Dde) protecting group scheme is preferred in cases where side chain lactam formation is desired (Houston, M. E., Jr., et al. (1995) J Pept Sci 1: 274-282; Murage, E. N., et al. (2010) J Med Chem), since in this case Fmoc-Glu(O-Allyl) and Fmoc-Lys(Alloc) can be incorporated and used to provide transient protection, then deprotected for lactam formation while the Lys(Dde) protecting group remains for later removal and reaction with the functionalized surfactant. The side chain lactam between acidic and basic residue (e.g. Glu and Lys) is carried out after removal of the allyl-based protection by activation of the carboxyl side chain function with N,N'-diisopropylcarbodiimide (DIC)/1-hydroxybenzotriazole (HOBt) or 2-(1H-benzotriazole-1-yl)-1,1,3,3-tetramethylaminium hexafluorophosphate (HBTU)/N,N-di-isopropylethylamine (DIEA), using standard protocols well known to the art.

In solid phase synthesis, the C-terminal amino acid is first attached to a suitable resin support. Suitable resin supports are those materials which are inert to the reagents and reaction conditions of the stepwise condensation and deprotection reactions, as well as being insoluble in the media used. Examples of commercially available resins include styrene/divinylbenzene resins modified with a reactive group, e.g., chloromethylated co-poly-(styrene-divinylbenzene), hydroxymethylated co-poly-(styrene-divinylbenzene), and the like. Benzylated, hydroxymethylated phenylacetamidomethyl (PAM) resin is preferred for the preparation of peptide acids. When the C-terminus of the compound is an amide, a preferred resin is p-methylbenzhydrylamino-co-poly(styrene-divinyl-benzene) resin, a 2,4 dimethoxybenzhydrylamino-based resin ("Rink amide"), and the like. An especially preferred support for the synthesis of larger peptides are commercially available resins containing PEG sequences grafted onto other polymeric matrices, such as the Rink Amide-PEG and PAL-PEG-PS resins (Applied Biosystems) or similar resins designed for peptide amide synthesis using the Fmoc protocol. Thus in certain cases it is desirable to have an amide linkage to a PEG chain. It those cases it is convenient to link an N-Fmoc-amino-PEG-carboxylic acid to the amide forming resin above (e.g. Rink amide resin and the like). The first amino acid of the chain can be coupled as an N-Fmoc-amino acid to the amino function of the PEG chain. Final deprotection will yield the desired Peptide-NH-PEG-CO—NH$_2$ product.

Attachment to the PAM resin may be accomplished by reaction of the Nα protected amino acid, for example the Boc-amino acid, as its ammonium, cesium, triethylammonium, 1,5-diazabicyclo-[5.4.0]undec-5-ene, tetramethylammonium, or similar salt in ethanol, acetonitrile, N,N-dimethylformamide (DMF), and the like, preferably the cesium salt in DMF, with the resin at an elevated temperature, for example between about 40° and 60° C., preferably about 50° C., for from about 12 to 72 hours, preferably about 48 hours. This will eventually yield the peptide acid product following acid cleavage or an amide following aminolysis.

The Nα-Boc-amino acid may be attached to the benzhydrylamine or HMP Am resin by means of, for example, an N,N'-diisopropylcarbodiimide (DIC)/1-hydroxybenzotriazole (HOBt) mediated coupling for from about 2 to about 24 hours, preferably about 2 hours at a temperature of between about 10° and 50° C., preferably 25° C. in a solvent such as CH$_2$Cl$_2$ or DMF, preferably CH$_2$Cl$_2$.

For Boc-based protocols, the successive coupling of protected amino acids may be carried out by methods well known in the art, typically in an automated peptide synthesizer. Following neutralization with triethylamine, N,N-diisopropylethylamine (DIEA), N-methylmorpholine (NMM), collidine, or similar base, each protected amino acid is introduced in approximately about 1.5 to 2.5 fold molar excess and the coupling carried out in an inert, nonaqueous, polar solvent such as CH$_2$Cl$_2$, DMF, N-methylpyrrolidone (NMP), N,N-dimethylacetamide (DMA), or mixtures thereof, preferably in dichloromethane at ambient temperature. For Fmoc-based protocols no acid is used for deprotection but a base, preferably DIEA or NMM, is usually incorporated into the coupling mixture. Couplings are typically done in DMF, NMP, DMA or mixed solvents, preferably DMF. Representative coupling agents are N,N'-dicyclohexylcarbodiimide (DCC), N,N'-diisopropylcarbodiimide (DIC) or other carbodiimide, either alone or in the presence of HOBt, O-acyl ureas, benzotriazol-1-yloxytris(pyrrolidino)phosphonium hexafluorophosphate (PyBop), N-hydroxysuccinimide, other N-hydroxyimides, or oximes. Alternatively, protected amino acid active esters (e.g. p-nitrophenyl, pentafluorophenyl and the like) or symmetrical anhydrides may be used. Preferred coupling agents are of the aminium/uronium (alternative nomenclatures used by suppliers) class such as 2-(1H-benzotriazole-1-yl)-1,1,3,3-tetramethylaminium hexafluorophosphate (HBTU), O-(7-azabenzotraiazole-1-yl)-1,1,3,3-tetramethyluronium hexafluorophosphate (HATU), 2-(6-Chloro-1H-benzotriazole-1-yl)-1,1,3,3-tetramethylaminium hexafluorophosphate (HCTU), and the like.

A preferred method of attachment to the Fmoc-PAL-PEG-PS resin may be accomplished by deprotection of the resin linker with 20% piperidine in DMF, followed by reaction of the N-α-Fmoc protected amino acid, about a 5 fold molar excess of the N-α-Fmoc-amino acid, using HBTU:di-isopropylethylamine (DIEA) (1:2) in DMF in a microwave-assisted peptide synthesizer with a 5 min, 75° max coupling cycle.

For this Fmoc-based protocol in the microwave-assisted peptide synthesizer, the N-α-Fmoc amino acid protecting groups are removed with 20% piperidine in DMF containing 0.1M 1-hydroxybenzotriazole (HOBt), in a double deprotection protocol for 30 sec and then for 3 min with a temperature maximum set at 75° C. HOBt is added to the deprotection solution to reduce aspartimide formation. Coupling of the next amino acid then employs a five-fold molar excess using HBTU:DIEA (1:2) with a 5 min, 75° max. double-coupling cycle.

At the end of the solid phase synthesis the fully protected peptide is removed from the resin. When the linkage to the resin support is of the benzyl ester type, cleavage may be effected by means of aminolysis with an alkylamine or fluoroalkylamine for peptides with an alkylamide C-terminus, or by ammonolysis with, for example, ammonia/methanol or ammonia/ethanol for peptides with an unsubstituted amide C-terminus, at a temperature between about –10° and 50° C., preferably about 25° C., for between about 12 and 24 hours, preferably about 18 hours. Peptides with a hydroxy C-terminus may be cleaved by HF or other strongly acidic deprotection regimen or by saponification. Alternatively, the peptide may be removed from the resin by transesterification, e.g., with methanol, followed by aminolysis or saponification. The protected peptide may be purified by silica gel or reverse-phase HPLC.

The side chain protecting groups may be removed from the peptide by treating the aminolysis product with, for example, anhydrous liquid hydrogen fluoride in the presence of anisole or other carbonium ion scavenger, treatment with hydrogen fluoride/pyridine complex, treatment with tris (trifluoroacetyl)boron and trifluoroacetic acid, by reduction with hydrogen and palladium on carbon or polyvinylpyrrolidone, or by reduction with sodium in liquid ammonia, preferably with liquid hydrogen fluoride and anisole at a temperature between about −10° and +10° C., preferably at about 0° C., for between about 15 minutes and 2 hours, preferably about 1.5 hours.

For peptides on the benzhydrylamine type resins, the resin cleavage and deprotection steps may be combined in a single step utilizing liquid hydrogen fluoride and anisole as described above or preferably through the use of milder cleavage cocktails. For example, for the PAL-PEG-PS resin, a preferred method is through the use of a double deprotection protocol in the microwave-assisted peptide synthesizer using one of the mild cleavage cocktails known in the art, such as TFA/water/tri-iso-propylsilane/3,6-dioxa-1,8-octanedithiol (DODT) (92.5/2.5/2.5/2.5) for 18 min at 38° C. each time. Cleavage of alkyl glycoside containing materials have shown survival of the alkyl glycoside linkage using protocols with TFA/water ratios in the 9/1 to 19/1 range. A typical cocktail is 94% TFA: 2% EDT; 2% $H_2O$; 2% TIS. Typically the fully deprotected product is precipitated and washed with cold (−70° to 4° C.) $Et_2O$, dissolved in deionized water and lyophilized.

The peptide solution may be desalted (e.g. with BioRad AG-3® anion exchange resin) and the peptide purified by a sequence of chromatographic steps employing any or all of the following types: ion exchange on a weakly basic resin in the acetate form; hydrophobic adsorption chromatography on underivatized co-poly(styrene-divinylbenzene), e.g. Amberlite® XAD; silica gel adsorption chromatography; ion exchange chromatography on carboxymethylcellulose; partition chromatography, e.g. on Sephadex® G-25; counter-current distribution; supercritical fluid chromatography; or HPLC, especially reversed-phase HPLC on octyl- or octadecylsilylsilica (ODS) bonded phase column packing.

Also provided herein are processes for preparing covalently modified peptides and/or proteins described herein and pharmaceutically acceptable salts thereof, which processes comprise sequentially condensing protected amino acids on a suitable resin support, removing the protecting groups and resin support, and purifying the product, to afford analogs of the physiologically active truncated homologs and analogs of the covalently modified peptides and/or proteins described herein. In some embodiments, covalently modified peptides and/or proteins described herein incorporate alkyl glycoside modifications as defined above. Another aspect relates to processes for preparing covalently modified peptides and/or proteins described herein and pharmaceutically acceptable salts thereof, which processes comprise the use of microwave-assisted solid phase synthesis-based processes or standard peptide synthesis protocols to sequentially condense protected amino acids on a suitable resin support, removing the protecting groups and resin support, and purifying the product, to afford analogs of the physiologically active peptides, as defined above.

Example 3-3: General Oxidation Method for Uronic Acids

To a solution of 1-dodecyl β-D-glucopyranoside (Carbosynth) [2.0 g, 5.74 mmol] in 20 mL of acetonitrile and 20 mL of DI water was added (diacetoxyiodo)benzene (Fluka) [4.4 g, 13.7 mmol] and TEMPO (SigmaAldrich) [0.180 g, 1.15 mmol]. The resulting mixture was stirred at room temperature for 20 h. The reaction was followed by mass spectrometry (for example LCQ ESI) and upon completion, the reaction mixture was diluted with water and lyophilized to dryness to give 1.52 g (crude yield 73.1%) of the crude product, 1-dodecyl β-D-glucuronic acid, as a white powder, which was used directly for the solid phase synthesis without further purification. This product was previously prepared by an alternative process using NaOCl as oxidant, as described in the specification, and also has been used for longer alkyl groups. In a similar manner are prepared the desired alkyl saccharide uronic acids used to make the products and reagents described herein.

In a like manner, but using the corresponding 1-tetradecyl, 1-hexadecyl, and 1-octadecyl β-D-glucopyranosides (purchased from Anatrace, Maumee, Ohio) were prepared the desired 1-alkyl saccharide uronic acids which were used to make the products and reagents described herein. For longer alkyl groups 1,4-dioxane was used instead of acetonitrile and the temperature was raised as high as 30° C.

In a like manner, but using, for example, the corresponding 1-octyl, 1-decyl, 1-undecyl, 1-tetradecyl, 1-hexadecyl, and 1-octadecyl glycosides (purchased from Anatrace, Maumee, Ohio) were prepared the desired 1-alkyl saccharide uronic acids which were used to make the products and reagents described herein. In a like manner, but using, for example, the corresponding 1-octyl, 1-decyl, 1-undecyl, 1-tetradecyl, 1-hexadecyl, and 1-octadecyl β-D-melibiosides or β-D-maltosides (purchased from Anatrace, Maumee, Ohio) were prepared the desired 1-alkyl disaccharide uronic acids which were used to make the products and reagents described herein. In each case the corresponding alpha glycosides can be treated similarly Example 3-4: Preparation of Analog EU-A387

A sample of Fmoc-His-Aib-Gln-Gly-Thr-Phe-Thr-Ser-Asp-Bip-Ser-Lys-Tyr-Leu-Glu-Ser-Lys(Alloc)-Rink amide resin was prepared by sequential addition of N-alpha-Fmoc protected amino acids as described in Example 1 and deprotected on the Lys-N-epsilon position by incubation with $Pd(PPh_3)_4$ (0.5 eq) and DMBA (20 eq) in $DMF/CH_2Cl_2$ (1:1) overnight in the dark at room temperature. Following washing by $DMF/CH_2Cl_2$, the Lys side chain was acylated with 1'-dodecyl β-D-glucuronic acid in $DMF/CH_2Cl_2$ through the use of DIC/HOBt. Completion of the coupling was checked by ninhydrin and the product was washed extensively with $CH_2Cl_2$.

The product resin was submitted to final deprotection and cleavage from the resin by treatment with the cleavage cocktail (94% TFA: 2% EDT; 2% $H_2O$; 2% TIS) for a period of 240 min at room temperature. The mixture was treated with $Et_2O$, to precipitate the product and washed extensively with $Et_2O$ to yield the crude title peptide product after drying in vacuo.

Purification was carried out in two batches by reversed phase (C18) hplc. The crude peptide was loaded on a 4.1×25 cm hplc column at a flow rate of 15 mL/min (15% organic modifier; acetic acid buffer) and eluted with a gradient from 15-45% buffer B in 60 min at 50° C. The product fraction was lyophilized to yield the title product peptide with a purity 98.03% by analytical hplc (18.6 min; 30-60% $CH_3CN$ in 0.1% TFA)/mass spectrometry (M+1 peak=2382.14).

Example 3-5: Preparation of Analog EU-A1024

A sample of Boc-His(Trt)-Aib-Gln(Trt)-Gly-Thr(tBu)-Phe-Thr(tBu)-Ser(tBu)-Asp(OtBu)-Tyr(tBu)-Ser(tBu)-Lys(Boc)-Tyr(tBu)-Leu-Asp(OtBu)-Glu(O-Allyl)-Gln(Trt)-Ala-Ala-Lys(Alloc)-Glu(O-tBu)-Phe-Ile-Lys(Dde)-Trp(Boc)-Leu-Leu-Gln(Trt)-Thr(tBu)-HMP amide resin (started from Fmoc-Thr(tBu)-HMP Am Resin, substitution 0.45 mmol/g) was prepared by sequential addition of N-alpha-Fmoc protected amino acids as described in Example 1. The allyl based side chains on Glu and Lys were deprotected by incubation with Pd(PPh$_3$)$_4$ (0.5 eq) and DMBA (20 eq) in DMF/CH$_2$Cl$_2$ (1:1) overnight in the dark at room temperature. The resin was washed with 0.5% DIEA in DMF (twice), 0.5% sodium diethyldithiocarbamate in DMF (twice) and DMF/CH$_2$Cl$_2$ until a light yellow resin was obtained. The side chain lactam linkage was formed by coupling the Glu and Lys with DIC/HOBT (5 equivalents) in DMF. The reaction was checked for completeness with ninhydrin and recoupled if necessary. Following washing by DMF/CH$_2$Cl$_2$, the Lys side chain was deprotected by incubation with 5% hydrazine hydrate in DMF (10 equivalents) twice, in each case for 15 min. Following washing by DMF/CH$_2$Cl$_2$ the side chain amino group of the deprotected Lys residue was reacted with 1'-tetradecyl β-D-melibiouronic acid in DMF/CH$_2$Cl$_2$ through the use of DIC/HOBt. Completion of the coupling was checked by ninhydrin and the product was washed extensively with CH$_2$Cl$_2$. Any couplings which were not complete by ninhydrin were rerun. In general, 10-12 g of peptide product resin was obtained from a 2 mmole synthesis.

The product resin is submitted to final deprotection and cleavage from the resin by treatment with the cleavage cocktail (94% TFA: 2% EDT; 2% H$_2$O; 2% TIS) for a period of 240 min at room temperature. The mixture was treated with Et$_2$O, to precipitate the product and washed extensively with Et$_2$O to yield the crude title peptide product after drying in vacuo. In general, 5 to 8 g crude product peptide was obtained.

Purification was carried out in two batches by reversed phase (C18) hplc. The crude peptide (1-1.5 g) was loaded on a 4.1×25 cm hplc column at a flow rate of 15 mL/min (15% organic modifier; 0.1% TFA buffer) and eluted with a gradient from 35-55% buffer B in 70 min at room temperature. Repurification of the less pure fractions was done for the fractions with a purity of >70%. The product fraction was lyophilized to yield the title product peptide with a purity 98.7% by analytical hplc (10.3 min; 45-75% CH$_3$CN in 0.1% TFA)/mass spectrometry (1317.67, +3 charged; 1976.13, +2 charged; molecular weight 3950.44). In a similar manner were prepared the other analogs of the invention, the characterization of which is illustrated below.

The corresponding 1-methyl and 1-octyl analogs of the title compound are prepared in a similar manner, but using the reagents 1'-methyl β-D-glucuronic acid and 1'-octyl β-D-glucuronic acid (Carbosynth). In a like manner, but using the corresponding 1-octyl, 1-decyl, 1-undecyl, 1-tetradecyl, 1-hexadecyl, and 1-octadecyl β-D-glucouronic acids (prepared as described above) were prepared the products of the invention. In a like manner, but using the corresponding 1-octyl, 1-decyl, 1-undecyl, 1-tetradecyl, 1-hexadecyl, and 1-octadecyl β-D-melibiouronic or β-D-maltouronic (prepared as described above) were prepared the products and reagents described herein. Alternatively, the 1-alkyl glucuronyl, or other uronic acylated analogs, may be prepared by initial purification of the deprotected or partially deprotected peptide followed by acylation by the desired uronic acid reagent.

Analysis and characterization was done by HPLC/mass spectrometry in positive ion mode using the eluent gradients given in the table below. Analysis and characterization was done by HPLC/mass spectrometry in positive ion mode using the eluent gradients given in the table below.

| Compound Name | Molecular Wt Expected | Molecular Wt found | HPLC (min; elution) |
| --- | --- | --- | --- |
| EU-A387 | 2379.66 | 2380.14 | 18.6 [b] |
| EU-A388 | 2393.69 | 2393.74 | 16.0 [a] |
| EU-A391 | 2317.62 | 2318.26 | 11.2 [b] |
| EU-A455 | 2988.36 | 2988.00 | 11.5 [b] |
| EU-A474 | 2570.86 | 2570.54 | 11.3 [b] |
| EU-A478 | 2459.75 | 2459.74 | 11.1 [b] |
| EU-A484 | 2544.86 | 2545.06 | 9.6 [b] |
| EU-A501 | 2904.2 | 2903.34 | 7.9 [b] |
| EU-A502 | 2776.07 | 2776.14 | 8.0 [b] |
| EU-A503 | 2704.98 | 2704.40 | 8.0 [b] |
| EU-A504 | 2548.80 | 2548.00 | 9.1 [b] |
| EU-A505 | 2392.61 | 2392.40 | 10.5 [b] |
| EU-A506 | 2305.53 | 2305.06 | 10.7 [b] |
| EU-A507 | 3763.23 | 3762.66 | 9.0 [b] |
| EU-A521 | 2303.56 | 2303.60 | 8.2 [c] |
| EU-A522 | 2315.60 | 2315.60 | 14.2 [d] |
| EU-A523 | 2615.94 | 2616.00 | 8.1 [b] |
| EU-A524 | 2459.75 | 2459.74 | 12.7 [d] |
| EU-A525 | 2459.75 | 2459.06 | 6.0 [c] |
| EU-A526 | 2473.75 | 2473.60 | 12.7 [d] |
| EU-A527 | 2390.64 | 2390.40 | 14.6 [d] |
| EU-A529 | 2546.83 | 2546.80 | 9.5 [b] |
| EU-A531 | 2546.83 | 2546.80 | 9.5 [b] |
| EU-A532 | 2559.00 | 2558.66 | 9.6 [b] |
| EU-A533 | 2560.96 | 2560.66 | 9.5 [b] |
| EU-A534 | 2544.99 | 2544.94 | 9.7 [b] |
| EU-A535 | 2573.05 | 2574.00 | 12.0 [b] |
| EU-A536 | 2602.96 | 2603.46 | 14.3 [b] |
| EU-A538 | 2516.99 | 2516.40 | 10.3 [b] |
| EU-A539 | 2657.20 | 2656.80 | 10.8 [b] |
| EU-A540 | 2685.20 | 2684.94 | 9.8 [c] |
| EU-A541 | 2713.20 | 2712.80 | 13.0 [c] |
| EU-A544 | 2631.94 | 2632.26 | 10.8 [b] |
| EU-A546 | 2687.94 | 2688.80 | 9.1 [c] |
| EU-A549 | 2388.67 | 2388.66 | 6.3 [e] |
| EU-A551 | 2444.67 | 2445.20 | 11.4 [e] |
| EU-A552 | 2472.67 | 2473.14 | 10.7 [f] |
| EU-A554 | 2560.86 | 2560.40 | 10.3 [c] |
| EU-A556 | 2616.86 | 2616.40 | 11.7 [e] |
| EU-A557 | 2644.86 | 2645.74 | 10.4 [f] |
| EU-A560 | 2570.86 | 2571.06 | 8.3 [c] |
| EU-A562 | 2626.86 | 2626.66 | 9.9 [e] |
| EU-A563 | 2654.86 | 2655.06 | 8.7 [f] |
| EU-A565 | 2542.80 | 2542.54 | 9.5 [c] |
| EU-A567 | 2598.80 | 2599.06 | 12.0 [e] |
| EU-A568 | 2626.80 | 2626.54 | 10.1 [f] |

HPLC gradients in 0.1% TFA
[a] 35 to 65% CH$_3$CN over 30 min.
[b] 30 to 60% CH$_3$CN over 20 min.
[c] 35 to 65% CH$_3$CN over 20 min.
[d] 25 to 55% CH$_3$CN over 20 min.
[e] 40 to 70% CH$_3$CN over 20 min.
[f] 45 to 75% CH$_3$CN over 20 min.
HPLC on Phenomenex Luna C18 5 micron 250 × 4.6 mm.

Additional compounds synthesized and analyzed as described above are:

| Compound Name | Molecular Wt Expected | Molecular Wt Found | HPLC (min; elution) |
| --- | --- | --- | --- |
| EU-A570 | 2656.16 | 2656.00 | 10.4 [b] |
| EU-A571 | 2684.16 | 2683.34 | 11.2 [c] |
| EU-A575 | 2670.16 | 2670.94 | 11.8 [b] |
| EU-A576 | 2698.16 | 2697.20 | 11.2 [c] |
| EU-A580 | 2668.20 | 2667.20 | 12.3 [b] |
| EU-A581 | 2696.20 | 2695.46 | 11.1 [c] |
| EU-A592 | 2724.20 | 2724.58 | 9.9 [e] |
| EU-A595 | 2682.20 | 2682.40 | 9.7 [c] |
| EU-A596 | 2710.20 | 2710.46 | 10.4 [c] |
| EU-A597 | 2738.20 | 2738.18 | 10.9 [e] |
| EU-A721 | 2461.85 | 2461.74 | 10.3 [b] |
| EU-A722 | 2475.85 | 2475.34 | 10.8 [b] |
| EU-A723 | 2459.88 | 2459.86 | 7.7 [c] |
| EU-A724 | 2473.88 | 2473.34 | 11.1 [b] |

-continued

| Compound Name | Molecular Wt Expected | Molecular Wt Found | HPLC (min; elution) |
|---|---|---|---|
| EU-A725 | 2471.92 | 2472.00 | 10.8 [b] |
| EU-A726 | 2557.03 | 2556.80 | 11.0 [b] |
| EU-A727 | 2485.92 | 2485.74 | 10.9 [b] |
| EU-A728 | 2513.92 | 2513.86 | 10.6 [c] |
| EU-A729 | 2541.92 | 2541.86 | 9.7 [e] |
| EU-A730 | 2569.92 | 2569.74 | 9.4 [f] |
| EU-A731 | 2425.88 | 2425.32 | 10.6 [d] |
| EU-A732 | 2476.95 | 2476.40 | 9.4 [c] |
| EU-A733 | 2381.83 | 2382.02 | 11.4 [b] |
| EU-A734 | 2616.09 | 2616.18 | 11.4 [b] |
| EU-A750 | 1611.89 | 1611.56 | 9.4 [c] |
| EU-A751 | 1625.89 | 1625.35 | 9.7 [c] |
| EU-A752 | 1709.93 | 1709.41 | 11.7 [g] |
| EU-A753 | 1637.84 | 1637.46 | 12.5 [b] |
| EU-A754 | 1651.84 | 1651.18 | 9.9 [c] |
| EU-A755 | 1711.93 | 1711.46 | 10.3 [h] |
| EU-A756 | 1671.98 | 1671.37 | 9.8 [e] |
| EU-A757 | 1770.02 | 1769.17 | 14.9 [g] |
| EU-A770 | 3333.61 | 3334.65 | 9.5 [b] |
| EU-A771 | 3678.25 | 3677.96 | 11.3 [c] |
| EU-A772 | 3762.25 | 3763.35 | 14.9 [e] |
| EU-A773 | 3790.31 | 3791.31 | 11.1 [f] |
| EU-A774 | 3475.74 | 3477.15 | 10.5 [d] |
| EU-A775 | 3820.38 | 3821.52 | 10.4 [c] |
| EU-A776 | 3904.38 | 3905.76 | 10.2 [f] |
| EU-A777 | 3932.44 | 3933.69 | 9.7 [f] |
| EU-A792 | 3793.43 | 3793.52 | 8.9 [f] |
| EU-A793 | 3821.43 | 3821.60 | 10.8 [f] |
| EU-A794 | 3849.43 | 3848.78 | 10.5 [g] |
| EU-A945 | 3777.18 | 3777.54 | 12.2 [e] |
| EU-A948 | 3861.18 | 3862.14 | 13.0 [f] |
| EU-A993 | 3759.22 | 3759.00 | 9.3 [f] |
| EU-A994 | 3787.22 | 3787.44 | 11.4 [f] |
| EU-A995 | 3815.22 | 3815.52 | 14.5 [g] |
| EU-A996 | 3843.22 | 3843.12 | 12.3 [g] |
| EU-A999 | 3935.35 | 3934.66 | 13.4 [e] |
| EU-A1011 | 3854.21 | 3854.38 | 14.2 [c] |
| EU-A1017 | 3896.26 | 3895.77 | 12.3 [c] |
| EU-A1023 | 3921.35 | 3921.15 | 10.5 [e] |
| EU-A1024 | 3950.44 | 3949.95 | 10.3 [f] |
| EU-A1026 | 4005.55 | 4004.64 | 12.8 [g] |
| EU-A1029 | 3939.31 | 3939.06 | 10.7 [e] |
| EU-A1032 | 4023.51 | 4025.22 | 13.9 [f] |
| EU-A1035 | 3840.21 | 3838.21 | 9.8 [e] |
| EU-A1041 | 3882.26 | 3880.50 | 9.6 [e] |
| EU-A1044 | 3966.46 | 3965.46 | 12.6 [f] |
| EU-A1167 | 3731.15 | 3731.42 | 8.9 [f] |
| EU-A1168 | 3745.15 | 3745.20 | 10.8 [i] |
| EU-A1173 | 3978.49 | 3977.00 | 12.9 [f] |

HPLC gradients in 0.1% TFA
[a] 35 to 65% CH$_3$CN over 30 min.
[b] 30 to 60% CH$_3$CN over 20 min.
[c] 35 to 65% CH$_3$CN over 20 min.
[d] 25 to 55% CH$_3$CN over 20 min.
[e] 40 to 70% CH$_3$CN over 20 min.
[f] 45 to 75% CH$_3$CN over 20 min.
[g] 50 to 80% CH$_3$CN over 20 min.
[h] 10 to 40% CH$_3$CN over 20 min.
[i] 30 to 90% CH$_3$CN over 20 min.
HPLC on was carried out on a Phenomenex Luna C18 5 micron 250 × 4.6 mm analytical column.

Example 3-6: Cellular Assay of the Compounds

Compounds were weighed precisely in an amount of approximately 1 mg and assayed in standard cellular assays (Cerep SA). The readout is the amount of cAMP generated in the cells treated with the test compounds, in either agonist or antagonist mode. The assay used was the stimulation of cAMP levels in the glucagon (human, cloned into CHO cells) and GLP-1 (murine cell line) cellular assays. The assays are described in Chicchi, G. G., et al. (1997) J Biol Chem 272: 7765-7769 and Runge, S., et al. (2003) Br J Pharmacol 138: 787-794.

For compound EU-A391 the GLCR cellular response does not change and the GLP1R cellular response rises steeply with and EC50 of 420 nM

| Compound | Structure | EC$_{50}$ GLP-1 R (nM) | EC$_{50}$ murine glucagon R (nM) |
|---|---|---|---|
| EU-A391 | 1-dodecyl | 420 | n.c. |
| EU-A455 | 1-dodecyl | 59 | 770 |
| EU-A474 | 1-dodecyl | 3000 | n.c. |
| EU-A478 | 1-dodecyl | n.c. | n.c. |
| EU-A484 | 1-dodecyl | n.c. | n.c. |
| EU-A501 | 1-dodecyl | 20000 | 12000 |
| EU-A502 | 1-dodecyl | 9400 | n.c. |
| EU-A503 | 1-dodecyl | n.c. | n.c. |
| EU-A504 | 1-dodecyl | 3100 | 1100 |
| EU-A505 | 1-dodecyl | 8500 | 6100 |
| EU-A506 | 1-dodecyl | 4600 | 1300 |
| EU-A507 | 1-dodecyl | 18 | 1 |
| EU-A521 | 1-dodecyl | n.c. | n.c. |
| EU-A522 | 1-dodecyl | n.c. | 9000 |
| EU-A523 | 1-dodecyl | n.c. | n.c. |
| EU-A524 | 1-dodecyl | n.c. | n.c. |
| EU-A525 | 1-dodecyl | n.c. | n.c. |
| EU-A526 | 1-dodecyl | n.c. | n.c. |
| EU-A527 | 1-dodecyl | n.c. | 5000 |
| EU-A529 | 1-dodecyl | n.c. | 7000 |
| EU-A531 | 1-dodecyl | 2100 | 1100 |
| EU-A532 | 1-dodecyl | 5000 | 2600 |
| EU-A533 | 1-dodecyl | 770 | 780 |
| EU-A534 | 1-dodecyl | 290 | 1900 |
| EU-A535 | 1-tetradecyl | §4800 | 2100 |
| EU-A536 | 1-hexadecyl | >10000 | 4400 |
| EU-A538 | 1-dodecyl | 270 | n.c. |
| EU-A539 | 1-dodecyl | 860 | 2300 |
| EU-A540 | 1-tetradecyl | n.c. | 8800 |
| EU-A541 | 1-hexadecyl | 800 | 5000 | n.c. means EC50 not calculable
§ means superagonist

A further series of cellular assays were carried out using standard cellular assays (DiscoveRx, LeadHunter assays) using readout of cAMP stimulation or arrestin activation. Compounds were weighed precisely in an amount of approximately 1 mg and shipped to DiscoveRx for dilution and assay. The assay used were for the glucagon (human, cloned into CHO cells) and GLP-1 (human, cloned into CHO cells) receptors in cellular assays.

| Compound | EC$_{50}$ cAMP GLP-1 R (nM) | EC$_{50}$ arrestin GLP-1 R (nM) | EC$_{50}$ cAMP glucagon R (nM) | EC$_{50}$ arrestin glucagon R (nM) |
|---|---|---|---|---|
| EU-A507 | 0.01 | 9 | 0.02 | 100 |
| EU-A534 | 87 | | 1100 | |
| EU-A538 | 55 | | 3500 | |
| EU-A750 | >1000 | | >1000 | |
| EU-A751 | >1000 | | >1000 | |
| EU-A752 | 146 | | >1000 | |
| EU-A753 | >1000 | | >1000 | |
| EU-A754 | 360 | | >1000 | |
| EU-A755 | 486 | | 471 | |
| EU-A756 | 611 | | >1000 | |
| EU-A757 | 6.7 | | >1000 | |
| EU-A770 | 0.01 | 2.3 | 0.5 | >100 |
| EU-A771 | 0.07 | 14.2 | 0.4 | >100 |
| EU-A772 | 0.07 | 8.4 | 5.4 | >100 |
| EU-A773 | 0.08 | 8.3 | 1.5 | >100 |
| EU-A774 | 0.009 | 6.8 | 0.15 | 22.7 |
| EU-A775 | 0.16 | 17 | 0.3 | 33.6 |
| EU-A776 | 1.2 | >100 | 6.5 | >100 |
| EU-A777 | 0.1 | 34.5 | 0.6 | 73 |
| EU-A792 | <0.05 | 27.9 | <0.05 | |
| EU-A793 | <0.05 | 23.8 | <0.05 | |
| EU-A794 | 0.05 | 59.4 | 0.18 | |

-continued

| Compound | EC$_{50}$ cAMP GLP-1 R (nM) | EC$_{50}$ arrestin GLP-1 R (nM) | EC$_{50}$ cAMP glucagon R (nM) | EC$_{50}$ arrestin glucagon R (nM) |
|---|---|---|---|---|
| EU-A945 | <0.05 | 9.4 | 0.06 | |
| EU-A948 | 0.08 | 25.6 | 9.1 | |
| EU-A992 | 0.009 | | 0.019 | |
| EU-A993 | <0.05 | 12.3 | <0.05 | |
| EU-A994 | 0.05 | 10.2 | <0.05 | |
| EU-A995 | 0.035 | 59.5 | 0.15 | |
| EU-A996 | 0.05 | >100 | 0.87 | |
| EU-A999 | 0.05 | | 0.015 | |
| EU-A1011 | 0.16 | | 0.51 | |
| EU-A1017 | 0.44 | | 0.10 | |
| EU-A1023 | 0.028 | | 0.035 | |
| EU-A1029 | 0.019 | | 0.06 | |
| EU-A1032 | 0.03 | | 5.4 | |
| EU-A1035 | 0.02 | | 0.19 | |
| EU-A1041 | 0.02 | | 0.13 | |
| EU-A1044 | 0.07 | | 0.57 | |
| EU-A1167 | 0.013 | | 0.019 | |
| EU-A1168 | 0.07 | | 0.14 | |

Example 3-7: In Vivo Assay of Compounds—db/db Mice

The 60 female db/db B6BKS (D) Leprdb/J (strain 000697) mice for this study were approximately 8 to 9 weeks old at arrival (Jackson Laboratory, Bar Harbor, Me.). The mice were randomized by weight and two treatment groups of 8 female mice each were administered the test articles, EU-A994, EU-A995, or EU-A1026, at dose levels of 100 or 300 nmoles/kg. One group of 8 female mice served as the vehicle control and received the vehicle, 0.2% BSA in saline, pH 7.4. One additional group of 8 female mice received the positive control article, liraglutide, at a dose level of 50 nmoles/kg. The test articles, vehicle, and positive control article were administered on Day 1, at approximately 0, 7, and 24 hours during the study via subcutaneous injection at a dose volume of 6 mL/kg.

Clinical observations were conducted at receipt, prior to randomization, and daily from Days 1 to 5. Body weights were measured and recorded at receipt, prior to randomization, and daily from Days 1 to 5. Food consumption was measured and recorded daily from Days 1 to 5. Blood samples for glucose analysis were collected pretest (Day −3) and at 0, 1, 2, 4, 8, 10, 24, 48, 72, and 96 hours following the first dose on Day 1. At study termination all animals were euthanized and the carcasses were discarded without further evaluation.

Figure 5:
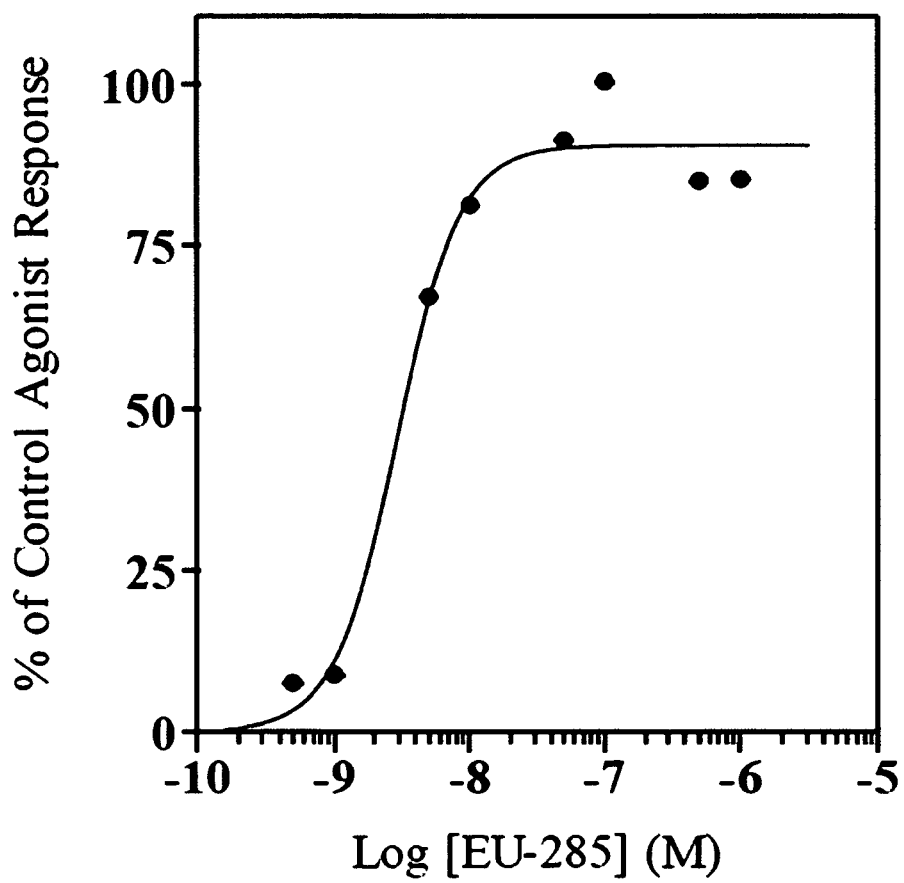
FIG. 5 shows the response of human cells in culture (SaOS2) to treatment with various doses of EU-285 (a coded sample of human PTHrP). The ordinate (vertical axis) shows the cAMP response as a percentage of the maximal response of the internal assay standard, i.e., PTHrP.
Figure 6:
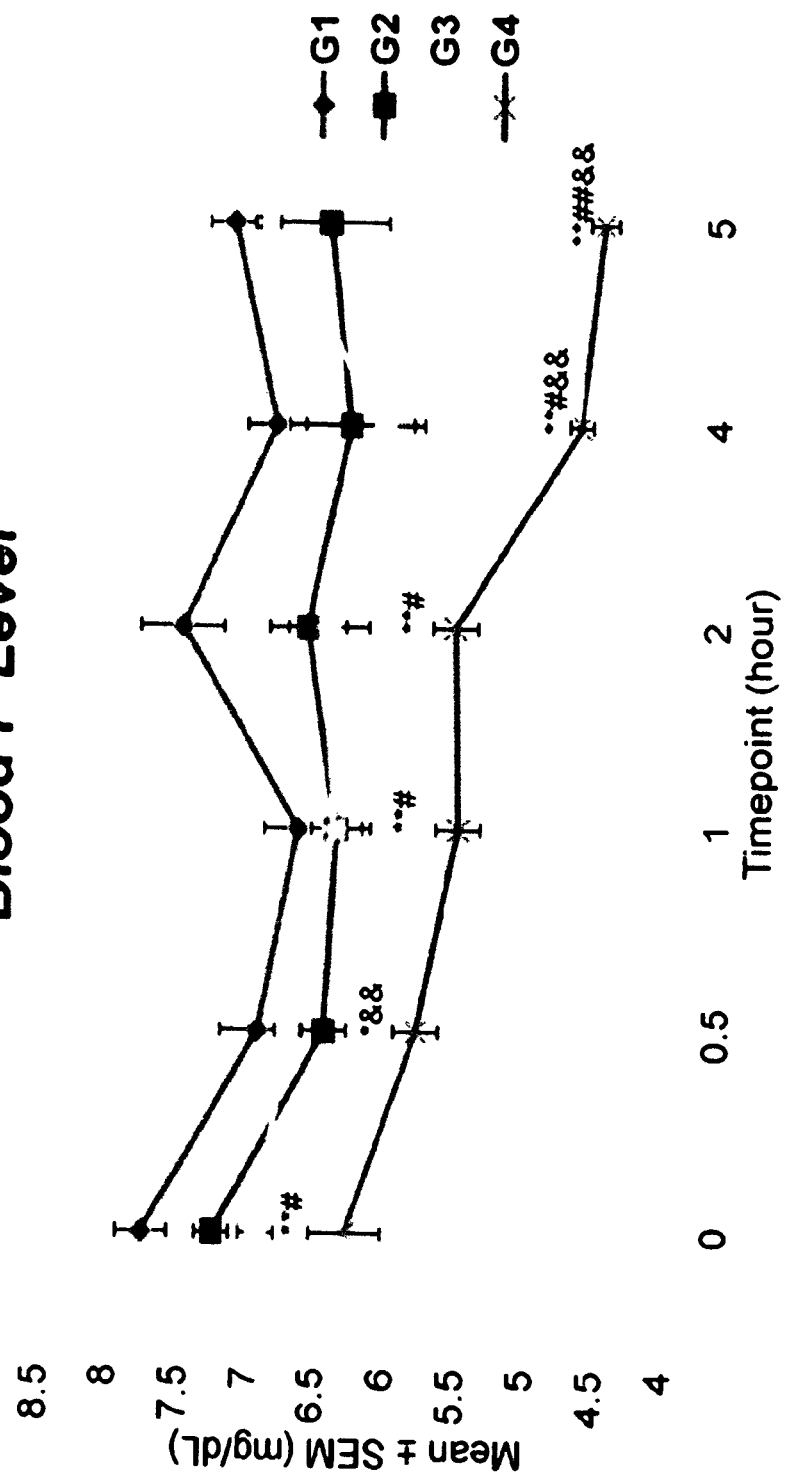
FIG. 6. Blood phosphate levels in rat serum were tested at various time points after subcutaneous dosing rats with saline (G1), 80 micrograms per kg of PTH (G2), 80 micrograms per kg of EU-232 (G3) or 320 micrograms per kg of EU-232 (G4). This surfactant modified analog, EU-232, demonstrates prolonged duration of action, as evidenced by the maximal statistically significant effect, which is seen at the last time point in the assay (i.e., 5 hrs post dosing). See Example 6.

Significant body weight changes were noted against vehicle for liraglutide and high dose EU-A994 and high dose EU-A1026 on Days 2 and 3 and low dose EU-A1026 on Days 3 and 4. In the food consumption analysis, liraglutide-treated animals were significantly different from vehicle on Days 1 and 2, high dose EU-A994 at Day 1, low dose EU-A995 at Day 1 and 2, high dose EU-A994 at Day 1, and low and high dose of EU-A1026 at Day 2 were significantly different from Liraglutide. Glucose levels for Liraglutide at 10 hours and high dose EU-A994 at 10 and 24 hours were significantly different from vehicle. Low dose EU-A995 and EU-A1026 at 10 hours were significantly different from liraglutide (FIG. 5). In a like manner, other analogs from the series were tested for effects on blood glucose, body weight and food consumption.

| Compound | Dose (nmole/kg) | db/db mice - Mean Blood Glucose (mg/dL) | | | |
|---|---|---|---|---|---|
| | | 0 hr | 10 hr | 24 hr | 48 hr |
| liraglutide | 50 | 595 | 265 | 347 | 377 |
| EU-A994 | 300 | 554 | 242 | 209 | 385 |
| EU-A995 | 300 | 503 | 471 | 493 | 527 |
| EU-A1026 | 300 | 531 | 399 | 438 | 505 |
| liraglutide | 50 | 528 | 286 | 404 | 477 |
| EU-A993 | 250 | 503 | 305 | 324 | 426 |
| EU-A995 | 250 | 539 | 584 | 548 | 546 |
| EU-A1023 | 50 | 507 | 310 | 355 | 375 |
| EU-A1023 | 250 | 508 | 264 | 194 | 375 |
| liraglutide | 50 | 442 | 174 | 244 | 439 |
| EU-A992 | 250 | 405 | 104 | 112 | 130 |
| EU-A1167 | 250 | 379 | 171 | 117 | 113 |
| EU-A1168 | 250 | 380 | 133 | 169 | 164 |

Example 3-8: In Vivo Assay of Compounds

Sixty (60) diet induced obese C57BL/6J male mice are received from JAX labs at 14 wks of age. The mice are ear notched for identification and housed in individually and positively ventilated polycarbonate cages with HEPA filtered air at density of one mouse per cage. The animal room is lighted entirely with artificial fluorescent lighting, with a controlled 12 h light/dark cycle. The normal temperature and relative humidity ranges in the animal rooms are 22±4° C. and 50±15%, respectively. Filtered tap water, acidified to a pH of 2.8 to 3.1, and high fat diet (60 kcal %) are provided ad libitum.

Following a 2 week acclimation, 40 mice are chosen based on desired body weight range and mice are randomized into groups (n=10) as below. Group 1. Vehicle treated; Group 2. Low dose test cmpd; Group 3. Mid dose test cmpd; Group 4. High dose test cmpd. Mice are dosed via SC daily for 28 days. Body weights and cage side observations are recorded daily. Food and water intake will be recorded weekly. Mice undergo NMR measurements for determining whole body fat and lean composition on days 1 (pre dose) and 26. On days 0, 14 and 27, mice are fasted overnight for an oral glucose tolerance test. Next day, the first blood sample is collected via tail nick (t=0). Mice are then administered a bolus of 1.0 g/kg glucose. Blood samples are obtained via tail nick at 5, 30, 60 and 120 min after glucose and plasma glucose will be immediately determined using a glucometer.

Sacrifice and tissue collection: Mice are sacrificed on day 29. Terminal blood is processed to serum/plasma and aliquots are sent for analysis of glucose, insulin and lipid profile. Body composition is determined by NMR. The optimal compound profile shows decreased glucose excursion in the OGTT, decreased basal insulin secretion, with potentiated glucose-dependent insulin secretion, decreased weight gain, decreased fat mass but minimal effects on lean mass.

Example 3-9: Plasma Protease Stability

Figure 15:
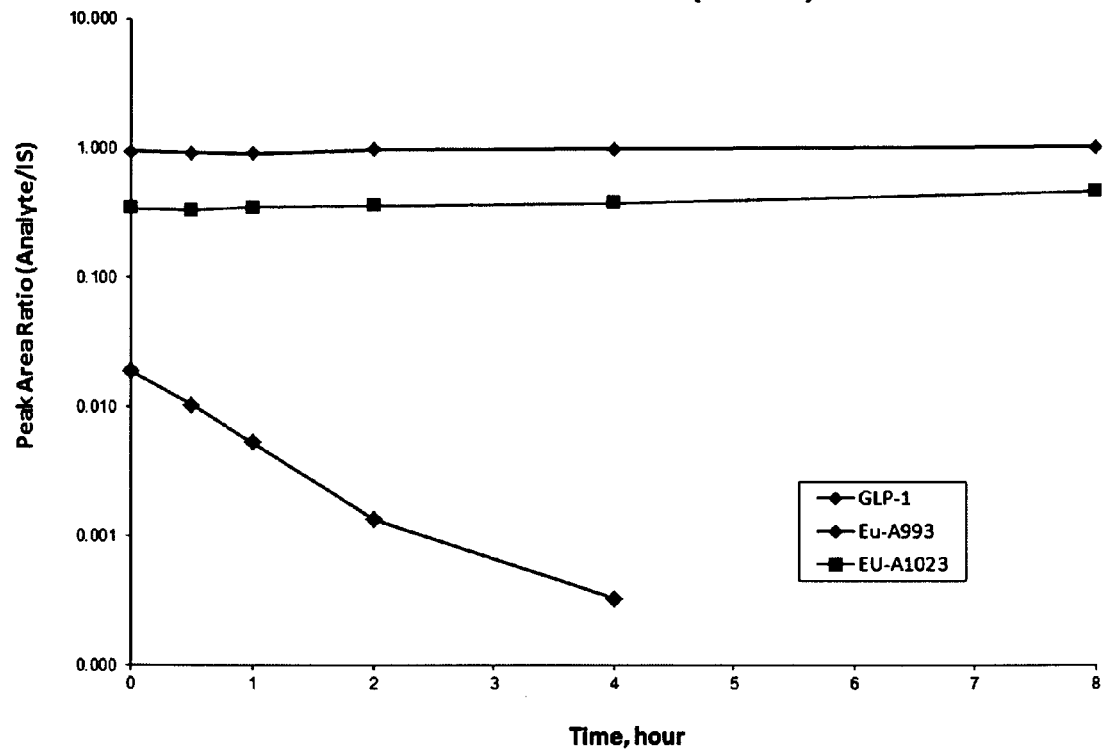
FIG. 15 illustrates the concentrations of compounds EU-A993, EU-A1023 and the native hormone GLP-1 (7-36) with time during incubation in human plasma. This data illustrates the prolonged half life and protection from proteolysis for the compounds of the invention.

Bioanalytical Method Development Summary I. Instruments used, API-4000 Mass Spectrometer, ESI positive, MRM Scan; Shimadzu HPLC/CTC Autosampler with ACE C8 column (2.1×50 mm, 5 μm), Mobile Phase A: 0.1% Formic acid, 5 mM NH$_4$OAc in water, Mobile Phase B: 0.1% Formic acid in CH$_3$CN, 10 μL of sample was injected, II. Standard and QC Sample Preparation: i. 1 mg/mL stock solution was prepared in DMSO/CH$_3$CN (1/1), ii. Make standard working solutions in 50% CH$_3$CN with the stock solution. The concentrations of the working solutions were 20, 50, 100, 200, 500, 1000, 2000, 5000, 10000 and 20000 ng/mL, iii. Spiked 10 μL of the working solutions into 90 μL blank plasma and vortex them, iv. Add 300 μL of internal standard solution (Verapamil, 20 ng/mL in 100% $CH_3CN$), vortex and centrifuge, v. Transfer the supernatant into an HPLC injection plate for loading on the HPLC column, vi. The standard samples were at 2, 5, 10, 20, 50, 100, 200, 500, 1000 and 2000 ng/mL. The QC samples were at 5 (LQC), 50 (MQC), and 500 (HQC) ng/mL. For the plasma stability study, samples of EU-A993, EU-A1023 and human GLP-1 (7-36, Bachem) were prepared in human plasma (approximately 6-20 ng/mL or similar concentrations above the limit of quantitation) and sampled at time points t=0, 0.5, 1, 2, 4, 8 hrs during incubation at 37 degC. Samples were treated with internal standard solution (100% $CH_3CN$) as described above in order to precipitate the proteins and supernatentants were loaded into an injection plate to load them onto the hplc column for quantitation by mass spectrometry. A plot of compound signal (amount) versus time shows rapid decrease in GlP-1 (7-36) and essentially no change over 8 hrs in the amount of intact compound in the human plasma for the compounds of the invention (see FIG. 15).

Example 3-10: Uses of the Compounds

The covalently modified peptides and/or proteins described herein are useful for the prevention and treatment of a variety of diseases related to obesity, the metabolic syndrome, cardiovascular disease and diabetes. Suitably labeled surfactant modified peptides can be used as diagnostic probes.

Representative delivery regimens include oral, parenteral (including subcutaneous, intramuscular and intravenous injection), rectal, buccal (including sublingual), transdermal, inhalation ocular and intranasal. An attractive and widely used method for delivery of peptides entails subcutaneous injection of a controlled release injectable formulation. Other administration routes for the application of the covalently modified peptides and/or proteins described herein are subcutaneous, intranasal and inhalation administration.

Example 3-11: Pharmaceutical Usage for Treatment of Insulin Resistance

A human patient, with evidence of insulin or metabolic syndrome is treated with EU-A596 by intranasal administration (200 μL) from a standard atomizer used in the art of a solution of the pharmaceutical agent in physiological saline containing from 0.5 to 10 mg/mL of the pharmaceutical agent and containing standard excipients such as benzyl alcohol. The treatment is repeated as necessary for the alleviation of symptoms such as obesity, elevated blood glucose and the like. In a similar manner, a solution of EU-A596, and selected excipients, in an evaporating solvent containing such as a hydrofluoroalkane is administered intranasally by metered dose inhaler (MDI) as needed to reduce insulin resistance. The effect of treatment is determined using standard tests including measurement of blood glucose levels, Body Mass Index, and/or body weight and/or measurement of waist to hip ratios.

In a similar manner, administration of an adjusted amount by transbuccal, intravaginal, inhalation, subcutaneous, intravenous, intraocular, or oral routes is tested to determine level of stimulation of GLP1R and/or GLCR on cells in the body and to determine therapeutic effects.

SEQUENCES

Table 1 in FIG. 1 depicts compounds that were prepared by methods described herein. The specification provides sequences for SEQ. ID. Nos. 1 and 149-169. Additionally, Table 1 of FIG. 1 provides SEQ. ID Numbers for compounds EU-A101 to EU-A199 and EU-A600 to EU-A649 having SEQ. ID. NOs. 2-148, and SEQ. ID. NO. 645 respectively, as shown in Table 1 of FIG. 1. Compounds in Table 1 of FIG. 1, and their respective SEQ. ID. NOs. shown in Table 1 of FIG. 1 are hereby incorporated into the specification as filed.

Table 2 in FIG. 2 depicts compounds that were prepared by methods described herein. The specification provides sequences for SEQ. ID. Nos. 170-174 and SEQ. ID. NOs. 283-302. Additionally, Table 2 of FIG. 2 provides SEQ. ID. Numbers for compounds EU-201 to EU-299 and EU-900 to EU-908 having SEQ. ID. NOs. 175-282 respectively, as shown in Table 2 of FIG. 2. Compounds in Table 2 of FIG. 2, and their respective SEQ. ID. NOs. shown in Table 2 of FIG. 2 are hereby incorporated into the specification as filed.

Table 3 in FIG. 8 depicts compounds that were prepared by methods described herein. The specification provides sequences for SEQ. ID. Nos. 303-305 and SEQ. ID. Nos. 619-644. Additionally, Table 3 of FIG. 8 provides SEQ. ID Numbers for compounds EU-A300 to EU-A425 having SEQ. ID. NOs. 306-431 respectively, as shown in Table 3 of FIG. 8. Compounds in Table 3 of FIG. 8, and their respective SEQ. ID. NOs. shown in Table 3 of FIG. 8 are hereby incorporated into the specification as filed.

Table 4 in FIG. 9 depicts compounds that were prepared by methods described herein. The specification provides SEQ. ID. Nos. 303-305 and SEQ. ID. Nos. 619-644. Additionally, Table 4 of FIG. 9 provides SEQ. ID Numbers for compounds EU-A426 to EU-A599 having SEQ. ID. NOs. 432-618 respectively, as shown in Table 4 of FIG. 9. Additionally, Table 4 of FIG. 9 provides SEQ. ID Numbers for compounds EU-A700 to EU-A1174 having SEQ. ID. NOs 646-1120. Compounds in Table 4 of FIG. 9, and their respective SEQ. ID. NOs. shown in Table 4 of FIG. 9 are hereby incorporated into the specification as filed.

SEQUENCE LISTING (1132 sequences)

SEQ ID NO: 1 - protein, 5 aa, Artificial Sequence
  Description of Artificial Sequence: Synthetic peptide
  MOD_RES (1)..(1): Tyr, Dmt, N-R3-Tyr, N-R3-Dmt, N-(R3)2-Tyr or N-(R3)2-Dmt
  MOD_RES (2)..(2): Pro, D-Arg, D-Cit, D-U(X), D-Ala, Tic or Tic(Psi[CH2-NH]); wherein "U" is any dibasic natural or unnatural amino acid, any natural or unnatural amino acid comprising a thiol, any unnatural amino acid comprising a -N3 group, any unnatural
  MOD_RES (2)..(2): continued from above; amino acid comprising an acetylenic group, or any unnatural amino acid comprising a -NH-C(=O)-CH2-Br or a -(CH2)m-maleimide, wherein m is 1-10, used for covalent attachment to the surfactant "X"
  MOD_RES (3)..(3): Phe, Trp, Tmp, D-or L-Nal(1), D-or L-Nal(2), C-alpha-MePhe or Psi-Phe
  MOD_RES (4)..(4): Phe, Tmp, D-or L-Nal(1), D-or L-Nal(2), U(X), D- or L-C-alpha-MeU(X);wherein "U" is any dibasic natural or unnatural amino acid, any natural or unnatural amino acid comprising a thiol, any unnatural amino acid comprising a
  MOD_RES (4)..(4): continued from above; -N3 group, any unnatural amino acid comprising an acetylenic group, or any unnatural amino acid comprising a -NH-C(=O)-CH2-Br or a -(CH2)m-maleimide, wherein m is 1-10, used for covalent attachment to the surfactant "X"
  MOD_RES (5)..(5): Absent or Pro, Aib, U(X), D- or L-C-alpha-MeU(X); wherein "U" is any dibasic natural or unnatural amino acid, any natural or unnatural amino acid comprising a thiol, any unnatural amino acid comprising a -N3 group, any unnatural amino acid comprising
  MOD_RES (5)..(5): continued from above; an acetylenic group, or any unnatural amino acid comprising a -NH-C(=O)-CH2-Br or a -(CH2)m-maleimide, wherein m is 1-10, used for covalent attachment to the surfactant "X"
  C-term OH or NH2
  see specification as filed for detailed description of substitutions and preferred embodiments
XXXXX

SEQ ID NO: 2 - protein, 4 aa, Artificial Sequence
  Description of Artificial Sequence: Synthetic peptide
  MOD_RES (1)..(1): Dmt
  MOD_RES (3)..(3): Tmp
  MOD_RES (4)..(4): Lys(C1-Glucuronyl)
  C-term NH2
YPFK

SEQ ID NO: 3 - protein, 4 aa, Artificial Sequence
  Description of Artificial Sequence: Synthetic peptide
  MOD_RES (1)..(1): Dmt
  MOD_RES (3)..(3): Tmp
  MOD_RES (4)..(4): Lys(C8-Glucuronyl)
  C-term NH2
YPFK

SEQ ID NO: 4 - protein, 4 aa, Artificial Sequence
  Description of Artificial Sequence: Synthetic peptide
  MOD_RES (1)..(1): Dmt
  MOD_RES (3)..(3): Tmp
  MOD_RES (4)..(4): Lys(C12-Glucuronyl)
  C-term NH2
YPFK

SEQ ID NO: 5 - protein, 5 aa, Artificial Sequence
  Description of Artificial Sequence: Synthetic peptide
  MOD_RES (1)..(1): Dmt
  MOD_RES (3)..(3): Tmp
  MOD_RES (5)..(5): Lys(C1-Glucuronyl)
  C-term amide
YPFFK

SEQ ID NO: 6 - protein, 5 aa, Artificial Sequence
  Description of Artificial Sequence: Synthetic peptide
  MOD_RES (1)..(1): Dmt
  MOD_RES (3)..(3): Tmp
  MOD_RES (5)..(5): Lys(C12-Glucuronyl)
  C-term amide
YPFFK

SEQ ID NO: 7 - protein, 4 aa, Artificial Sequence
  Description of Artificial Sequence: Synthetic peptide
  MOD_RES (1)..(1): Dmt
  MOD_RES (2)..(2): D-Lys(C1-Glucuronyl)
  MOD_RES (3)..(3): TMP
  C-term NH2
YKFF

SEQ ID NO: 8 - protein, 4 aa, Artificial Sequence
  Description of Artificial Sequence: Synthetic peptide
  MOD_RES (1)..(1): Dmt
  MOD_RES (2)..(2): D-Lys(C12-Glucuronyl)
  MOD_RES (3)..(3): TMP
  C-term NH2
YKFF

SEQ ID NO: 9 - protein, 4 aa, Artificial Sequence
  Description of Artificial Sequence: Synthetic peptide
  MOD_RES (1)..(1): Dmt
  MOD_RES (2)..(2): D-Lys(C8-Glucuronyl)
  MOD_RES (3)..(3): TMP
  C-term NH2
YKFF

SEQ ID NO: 10 - protein, 4 aa, Artificial Sequence
  Description of Artificial Sequence: Synthetic peptide
  MOD_RES (1)..(1): Dmt
  MOD_RES (2)..(2): D-Lys(C10-Glucuronyl)
  MOD_RES (3)..(3): TMP
  C-term NH2
YKFF

SEQ ID NO: 11 - protein, 4 aa, Artificial Sequence
  Description of Artificial Sequence: Synthetic peptide
  MOD_RES (1)..(1): Dmt
  MOD_RES (2)..(2): D-Lys(C16-Glucuronyl)
  MOD_RES (3)..(3): TMP
  C-term NH2
YKFF

SEQ ID NO: 12 - protein, 4 aa, Artificial Sequence
  Description of Artificial Sequence: Synthetic peptide
  MOD_RES (1)..(1): Dmt
  MOD_RES (2)..(2): D-Lys(C18-Glucuronyl)
  MOD_RES (3)..(3): TMP
  C-term NH2
YKFF

SEQ ID NO: 13 - protein, 4 aa, Artificial Sequence
  Description of Artificial Sequence: Synthetic peptide
  MOD_RES (1)..(1): Dmt
  MOD_RES (2)..(2): D-Lys(C20-Glucuronyl)
  MOD_RES (3)..(3): TMP
  C-term NH2
YKFF

SEQ ID NO: 14 - protein, 4 aa, Artificial Sequence
  Description of Artificial Sequence: Synthetic peptide
  MOD_RES (1)..(1): Dmt
  MOD_RES (2)..(2): D-Lys(C22-Glucuronyl)
  MOD_RES (3)..(3): TMP
  C-term NH2
YKFF

SEQ ID NO: 15 - protein, 4 aa, Artificial Sequence
  Description of Artificial Sequence: Synthetic peptide
  MOD_RES (1)..(1): Dmt
  MOD_RES (2)..(2): D-Lys(C24-Glucuronyl)
  MOD_RES (3)..(3): TMP
  C-term NH2
YKFF

SEQ ID NO: 16 - protein, 4 aa, Artificial Sequence
  Description of Artificial Sequence: Synthetic peptide
  MOD_RES (1)..(1): Dmt
  MOD_RES (2)..(2): D-Lys(OPEG2k-Glucuronyl)
  MOD_RES (3)..(3): TMP
  C-term NH2
YKFF

SEQ ID NO: 17 - protein, 4 aa, Artificial Sequence
  Description of Artificial Sequence: Synthetic peptide
  MOD_RES (1)..(1): Dmt
  MOD_RES (2)..(2): D-Lys(OPEG30k-Glucuronyl)
  MOD_RES (3)..(3): TMP
  C-term NH2
YKFF

SEQ ID NO: 18 - protein, 4 aa, Artificial Sequence
  Description of Artificial Sequence: Synthetic peptide
  MOD_RES (1)..(1): Dmt
  MOD_RES (2)..(2): D-Lys(C1-Glucuronyl)
  MOD_RES (3)..(3): Nal(1)
  C-term NH2
YKAF

SEQ ID NO: 19 - protein, 4 aa, Artificial Sequence
  Description of Artificial Sequence: Synthetic peptide
  MOD_RES (1)..(1): Dmt
  MOD_RES (2)..(2): D-Lys(C12-Glucuronyl)
  MOD_RES (3)..(3): Nal(1)
  C-term NH2
YKAF

SEQ ID NO: 20 - protein, 4 aa, Artificial Sequence
  Description of Artificial Sequence: Synthetic peptide
  MOD_RES (1)..(1): Dmt
  MOD_RES (2)..(2): D-Lys(C8-Glucuronyl)
  MOD_RES (3)..(3): Nal(1)
  C-term NH2
YKAF

SEQ ID NO: 21 - protein, 4 aa, Artificial Sequence
  Description of Artificial Sequence: Synthetic peptide
  MOD_RES (1)..(1): Dmt
  MOD_RES (2)..(2): D-Lys(C12-Glucuronyl)
  MOD_RES (3)..(3): Nal(1)
  C-term NH2
YKAF

SEQ ID NO: 22 - protein, 4 aa, Artificial Sequence
  Description of Artificial Sequence: Synthetic peptide
  MOD_RES (1)..(1): Dmt
  MOD_RES (2)..(2): D-Lys(C16-Glucuronyl)
  MOD_RES (3)..(3): Nal(1)
  C-term NH2
YKAF

SEQ ID NO: 23 - protein, 4 aa, Artificial Sequence
  Description of Artificial Sequence: Synthetic peptide
  MOD_RES (1)..(1): Dmt
  MOD_RES (2)..(2): D-Lys(C18-Glucuronyl)
  MOD_RES (3)..(3): Nal(1)
  C-term NH2
YKAF

SEQ ID NO: 24 - protein, 4 aa, Artificial Sequence
  Description of Artificial Sequence: Synthetic peptide
  MOD_RES (1)..(1): Dmt
  MOD_RES (2)..(2): D-Lys(C20-Glucuronyl)
  MOD_RES (3)..(3): Nal(1)
  C-term NH2
YKAF

SEQ ID NO: 25 - protein, 4 aa, Artificial Sequence
  Description of Artificial Sequence: Synthetic peptide
  MOD_RES (1)..(1): Dmt
  MOD_RES (2)..(2): D-Lys(C22-Glucuronyl)
  MOD_RES (3)..(3): Nal(1)
  C-term NH2
YKAF

SEQ ID NO: 26 - protein, 4 aa, Artificial Sequence
  Description of Artificial Sequence: Synthetic peptide
  MOD_RES (1)..(1): Dmt
  MOD_RES (2)..(2): D-Lys(C24-Glucuronyl)
  MOD_RES (3)..(3): Nal(1)
  C-term NH2
YKAF

SEQ ID NO: 27 - protein, 4 aa, Artificial Sequence
  Description of Artificial Sequence: Synthetic peptide
  MOD_RES (1)..(1): Dmt
  MOD_RES (2)..(2): D-Lys(OPEG2k-Glucuronyl)
  MOD_RES (3)..(3): Nal(1)
  C-term NH2
YKAF

SEQ ID NO: 28 - protein, 4 aa, Artificial Sequence
  Description of Artificial Sequence: Synthetic peptide
  MOD_RES (1)..(1): Dmt
  MOD_RES (2)..(2): D-Lys(OPEG30k-Glucuronyl)
  MOD_RES (3)..(3): Nal(1)
  C-term NH2
YKAF

SEQ ID NO: 29 - protein, 4 aa, Artificial Sequence
  Description of Artificial Sequence: Synthetic peptide
  MOD_RES (1)..(1): Dmt
  MOD_RES (2)..(2): D-Lys(C1-Glucuronyl)
  MOD_RES (3)..(3): TMP
  C-term NH2
YKFK

SEQ ID NO: 30 - protein, 4 aa, Artificial Sequence
  Description of Artificial Sequence: Synthetic peptide
  MOD_RES (1)..(1): Dmt
  MOD_RES (2)..(2): D-Lys(C12-Glucuronyl)
  MOD_RES (3)..(3): TMP
  C-term NH2
YKFK

SEQ ID NO: 31 - protein, 4 aa, Artificial Sequence
  Description of Artificial Sequence: Synthetic peptide
  MOD_RES (1)..(1): Dmt
  MOD_RES (2)..(2): D-Lys(C8-Glucuronyl)
  MOD_RES (3)..(3): TMP
  C-term NH2
YKFK

SEQ ID NO: 32 - protein, 4 aa, Artificial Sequence
  Description of Artificial Sequence: Synthetic peptide
  MOD_RES (1)..(1): Dmt
  MOD_RES (2)..(2): D-Lys(C10-Glucuronyl)
  MOD_RES (3)..(3): TMP
  C-term NH2
YKFK

SEQ ID NO: 33 - protein, 4 aa, Artificial Sequence
  Description of Artificial Sequence: Synthetic peptide
  MOD_RES (1)..(1): Dmt
  MOD_RES (2)..(2): D-Lys(C16-Glucuronyl)
  MOD_RES (3)..(3): TMP
  C-term NH2
YKFK

SEQ ID NO: 34 - protein, 4 aa, Artificial Sequence
  Description of Artificial Sequence: Synthetic peptide
  MOD_RES (1)..(1): Dmt
  MOD_RES (2)..(2): D-Lys(C18-Glucuronyl)
  MOD_RES (3)..(3): TMP
  C-term NH2
YKFK

SEQ ID NO: 35 - protein, 4 aa, Artificial Sequence
  Description of Artificial Sequence: Synthetic peptide
  MOD_RES (1)..(1): Dmt
  MOD_RES (2)..(2): D-Lys(C20-Glucuronyl)
  MOD_RES (3)..(3): TMP
  C-term NH2
YKFK

SEQ ID NO: 36 - protein, 4 aa, Artificial Sequence
  Description of Artificial Sequence: Synthetic peptide
  MOD_RES (1)..(1): Dmt
  MOD_RES (2)..(2): D-Lys(C22-Glucuronyl)
  MOD_RES (3)..(3): TMP
  C-term NH2
YKFK

SEQ ID NO: 37 - protein, 4 aa, Artificial Sequence
  Description of Artificial Sequence: Synthetic peptide
  MOD_RES (1)..(1): Dmt
  MOD_RES (2)..(2): D-Lys(C24-Glucuronyl)
  MOD_RES (3)..(3): TMP
  C-term NH2
YKFK

SEQ ID NO: 38 - protein, 4 aa, Artificial Sequence
  Description of Artificial Sequence: Synthetic peptide
  MOD_RES (1)..(1): Dmt
  MOD_RES (2)..(2): D-Lys(OPEG2k-Glucuronyl)
  MOD_RES (3)..(3): TMP
  C-term NH2
YKFK

SEQ ID NO: 39 - protein, 4 aa, Artificial Sequence
  Description of Artificial Sequence: Synthetic peptide
  MOD_RES (1)..(1): Dmt
  MOD_RES (2)..(2): D-Lys(OPEG30k-Glucuronyl)
  MOD_RES (3)..(3): TMP
  C-term NH2
YKFK

SEQ ID NO: 40 - protein, 4 aa, Artificial Sequence
  Description of Artificial Sequence: Synthetic peptide
  MOD_RES (1)..(1): Dmt
  MOD_RES (2)..(2): D-Lys(C1-Glucuronyl)
  MOD_RES (3)..(3): Nal(2)
  C-term NH2
YKAK

SEQ ID NO: 41 - protein, 4 aa, Artificial Sequence
  Description of Artificial Sequence: Synthetic peptide
  MOD_RES (1)..(1): Dmt
  MOD_RES (2)..(2): D-Lys(C12-Glucuronyl)
  MOD_RES (3)..(3): Nal(2)
  C-term NH2
YKAK

SEQ ID NO: 42 - protein, 4 aa, Artificial Sequence
  Description of Artificial Sequence: Synthetic peptide
  MOD_RES (1)..(1): Dmt
  MOD_RES (2)..(2): D-Lys(C8-Glucuronyl)
  MOD_RES (3)..(3): Nal(2)
  C-term NH2
YKAK

SEQ ID NO: 43 - protein, 4 aa, Artificial Sequence
  Description of Artificial Sequence: Synthetic peptide
  MOD_RES (1)..(1): Dmt
  MOD_RES (2)..(2): D-Lys(C10-Glucuronyl)
  MOD_RES (3)..(3): Nal(2)
  C-term NH2
YKAK

SEQ ID NO: 44 - protein, 4 aa, Artificial Sequence
  Description of Artificial Sequence: Synthetic peptide
  MOD_RES (1)..(1): Dmt
  MOD_RES (2)..(2): D-Lys(C16-Glucuronyl)
  MOD_RES (3)..(3): Nal(2)
  C-term NH2
YKAK

SEQ ID NO: 45 - protein, 4 aa, Artificial Sequence
  Description of Artificial Sequence: Synthetic peptide
  MOD_RES (1)..(1): Dmt
  MOD_RES (2)..(2): D-Lys(C18-Glucuronyl)
  MOD_RES (3)..(3): Nal(2)
  C-term NH2
YKAK

SEQ ID NO: 46 - protein, 4 aa, Artificial Sequence
  Description of Artificial Sequence: Synthetic peptide
  MOD_RES (1)..(1): Dmt
  MOD_RES (2)..(2): D-Lys(C20-Glucuronyl)
  MOD_RES (3)..(3): Nal(2)
  C-term NH2
YKAK

SEQ ID NO: 47 - protein, 4 aa, Artificial Sequence
  Description of Artificial Sequence: Synthetic peptide
  MOD_RES (1)..(1): Dmt
  MOD_RES (2)..(2): D-Lys(C22-Glucuronyl)
  MOD_RES (3)..(3): Nal(2)
  C-term NH2
YKAK

SEQ ID NO: 48 - protein, 4 aa, Artificial Sequence
  Description of Artificial Sequence: Synthetic peptide
  MOD_RES (1)..(1): Dmt
  MOD_RES (2)..(2): D-Lys(C24-Glucuronyl)
  MOD_RES (3)..(3): Nal(2)
  C-term NH2
YKAK

SEQ ID NO: 49 - protein, 4 aa, Artificial Sequence
  Description of Artificial Sequence: Synthetic peptide
  MOD_RES (1)..(1): Dmt
  MOD_RES (2)..(2): D-Lys(OPEG2k-Glucuronyl)
  MOD_RES (3)..(3): Nal(2)
  C-term NH2
YKAK

SEQ ID NO: 50 - protein, 4 aa, Artificial Sequence
  Description of Artificial Sequence: Synthetic peptide
  MOD_RES (1)..(1): Dmt
  MOD_RES (2)..(2): D-Lys(OPEG30k-Glucuronyl)
  MOD_RES (3)..(3): Nal(2)
  C-term NH2
YKAK

SEQ ID NO: 51 - protein, 4 aa, Artificial Sequence
  Description of Artificial Sequence: Synthetic peptide
  MOD_RES (1)..(1): Dmt
  MOD_RES (2)..(2): D-Lys(C1-Glucuronyl)
  C-term NH2
YKFK

SEQ ID NO: 52 - protein, 4 aa, Artificial Sequence
  Description of Artificial Sequence: Synthetic peptide
  MOD_RES (1)..(1): Dmt
  MOD_RES (2)..(2): D-Lys(C12-Glucuronyl)
  C-term NH2
YKFK

SEQ ID NO: 53 - protein, 4 aa, Artificial Sequence
  Description of Artificial Sequence: Synthetic peptide
  MOD_RES (1)..(1): Dmt
  MOD_RES (2)..(2): D-Lys(C8-Glucuronyl)
  C-term NH2
YKFK

SEQ ID NO: 54 - protein, 4 aa, Artificial Sequence
  Description of Artificial Sequence: Synthetic peptide
  MOD_RES (1)..(1): Dmt
  MOD_RES (2)..(2): D-Lys(C10-Glucuronyl)
  C-term NH2
YKFK

SEQ ID NO: 55 - protein, 4 aa, Artificial Sequence
  Description of Artificial Sequence: Synthetic peptide
  MOD_RES (1)..(1): Dmt
  MOD_RES (2)..(2): D-Lys(C16-Glucuronyl)
  C-term NH2
YKFK

SEQ ID NO: 56 - protein, 4 aa, Artificial Sequence
  Description of Artificial Sequence: Synthetic peptide
  MOD_RES (1)..(1): Dmt
  MOD_RES (2)..(2): D-Lys(C18-Glucuronyl)
  C-term NH2
YKFK

SEQ ID NO: 57 - protein, 4 aa, Artificial Sequence
  Description of Artificial Sequence: Synthetic peptide
  MOD_RES (1)..(1): Dmt
  MOD_RES (2)..(2): D-Lys(C20-Glucuronyl)
  C-term NH2
YKFK

SEQ ID NO: 58 - protein, 4 aa, Artificial Sequence
  Description of Artificial Sequence: Synthetic peptide
  MOD_RES (1)..(1): Dmt
  MOD_RES (2)..(2): D-Lys(C22-Glucuronyl)
  C-term NH2
YKFK

SEQ ID NO: 59 - protein, 4 aa, Artificial Sequence
  Description of Artificial Sequence: Synthetic peptide
  MOD_RES (1)..(1): Dmt
  MOD_RES (2)..(2): D-Lys(C24-Glucuronyl)
  C-term NH2
YKFK

SEQ ID NO: 60 - protein, 4 aa, Artificial Sequence
  Description of Artificial Sequence: Synthetic peptide
  MOD_RES (1)..(1): Dmt
  MOD_RES (2)..(2): D-Lys(OPEG2k-Glucuronyl)
  C-term NH2
YKFK

SEQ ID NO: 61 - protein, 4 aa, Artificial Sequence
  Description of Artificial Sequence: Synthetic peptide
  MOD_RES (1)..(1): Dmt
  MOD_RES (2)..(2): D-Lys(OPEG30k-Glucuronyl)
  C-term NH2
YKFK

SEQ ID NO: 62 - protein, 4 aa, Artificial Sequence
  Description of Artificial Sequence: Synthetic peptide
  MOD_RES (1)..(1): Dmt
  MOD_RES (4)..(4): Lys(C1-Glucuronyl)
  C-term NH2
YPFK

SEQ ID NO: 63 - protein, 4 aa, Artificial Sequence
  Description of Artificial Sequence: Synthetic peptide
  MOD_RES (1)..(1): Dmt
  MOD_RES (4)..(4): Lys(C8-Glucuronyl)
  C-term NH2
YPFK

SEQ ID NO: 64 - protein, 4 aa, Artificial Sequence
  Description of Artificial Sequence: Synthetic peptide
  MOD_RES (1)..(1): Dmt
  MOD_RES (4)..(4): Lys(C12-Glucuronyl)
  C-term NH2
YPFK

SEQ ID NO: 65 - protein, 4 aa, Artificial Sequence
  Description of Artificial Sequence: Synthetic peptide
  MOD_RES (1)..(1): Dmt
  MOD_RES (4)..(4): D-Lys(C1-Glucuronyl)
  C-term NH2
YPFK

SEQ ID NO: 66 - protein, 4 aa, Artificial Sequence
  Description of Artificial Sequence: Synthetic peptide
  MOD_RES (1)..(1): Dmt
  MOD_RES (4)..(4): D-Lys(C8-Glucuronyl)
  C-term NH2
YPFK

SEQ ID NO: 67 - protein, 4 aa, Artificial Sequence
  Description of Artificial Sequence: Synthetic peptide
  MOD_RES (1)..(1): Dmt
  MOD_RES (4)..(4): D-Lys(C12-Glucuronyl)
  C-term NH2
YPFK

SEQ ID NO: 68 - protein, 5 aa, Artificial Sequence
  Description of Artificial Sequence: Synthetic peptide
  MOD_RES (1)..(1): Dmt
  MOD_RES (4)..(4): Lys(C1-Glucuronyl)
  C-term amide
YPFKP

SEQ ID NO: 69 - protein, 5 aa, Artificial Sequence
  Description of Artificial Sequence: Synthetic peptide
  MOD_RES (1)..(1): Dmt
  MOD_RES (4)..(4): Lys(C8-Glucuronyl)
  C-term amide
YPFKP

SEQ ID NO: 70 - protein, 5 aa, Artificial Sequence
  Description of Artificial Sequence: Synthetic peptide
  MOD_RES (1)..(1): Dmt
  MOD_RES (4)..(4): Lys(C12-Glucuronyl)
  C-term amide
YPFKP

SEQ ID NO: 71 - protein, 4 aa, Artificial Sequence
  Description of Artificial Sequence: Synthetic peptide
  MOD_RES (1)..(1): Dmt
  MOD_RES (4)..(4): MeLys(C1-Glucuronyl)
  C-term NH2
YPFK

SEQ ID NO: 72 - protein, 4 aa, Artificial Sequence
  Description of Artificial Sequence: Synthetic peptide
  MOD_RES (1)..(1): Dmt
  MOD_RES (4)..(4): MeLys(C8-Glucuronyl)
  C-term NH2
YPFK

SEQ ID NO: 73 - protein, 4 aa, Artificial Sequence
  Description of Artificial Sequence: Synthetic peptide
  MOD_RES (1)..(1): Dmt
  MOD_RES (4)..(4): MeLys(C12-Glucuronyl)
  C-term NH2
YPFK

SEQ ID NO: 74 - protein, 5 aa, Artificial Sequence
  Description of Artificial Sequence: Synthetic peptide
  MOD_RES (1)..(1): Dmt
  MOD_RES (5)..(5): Lys(C1-Glucuronyl)
  C-term amide
YPFFK

SEQ ID NO: 75 - protein, 5 aa, Artificial Sequence
  Description of Artificial Sequence: Synthetic peptide
  MOD_RES (1)..(1): Dmt
  MOD_RES (5)..(5): Lys(C12-Glucuronyl)
  C-term amide
YPFFK

SEQ ID NO: 76 - protein, 5 aa, Artificial Sequence
  Description of Artificial Sequence: Synthetic peptide
  MOD_RES (1)..(1): Dmt
  MOD_RES (5)..(5): MeLys(C1-Glucuronyl)
  C-term amide
YPFFK

SEQ ID NO: 77 - protein, 5 aa, Artificial Sequence
  Description of Artificial Sequence: Synthetic peptide
  MOD_RES (1)..(1): Dmt
  MOD_RES (5)..(5): MeLys(C12-Glucuronyl)
  C-term amide
YPFFK

SEQ ID NO: 78 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C1-Glucuronyl)
  C-term NH2
YXFK

SEQ ID NO: 79 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C12-Glucuronyl)
  C-term NH2
YXFK

SEQ ID NO: 80 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C8-Glucuronyl)
  C-term NH2
YXFK

SEQ ID NO: 81 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C10-Glucuronyl)
  C-term NH2
YXFK

SEQ ID NO: 82 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C16-Glucuronyl)
  C-term NH2
YXFK

SEQ ID NO: 83 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C18-Glucuronyl)
  C-term NH2
YXFK

SEQ ID NO: 84 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C20-Glucuronyl)
  C-term NH2
YXFK

SEQ ID NO: 85 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C22-Glucuronyl)
  C-term NH2
YXFK

SEQ ID NO: 86 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C24-Glucuronyl)
  C-term NH2
YXFK

SEQ ID NO: 87 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(OPEG2k-Glucuronyl)
  C-term NH2
YXFK

SEQ ID NO: 88 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(OPEG30k-Glucuronyl)
  C-term NH2
YXFK

SEQ ID NO: 89 - protein, 5 aa, Artificial Sequence
  Description of Artificial Sequence: Synthetic peptide
  MOD_RES (1)..(1): Dmt
  MOD_RES (2)..(2): Tic
  MOD_RES (5)..(5): Lys(C1-Glucuronyl)
  C-term amide
YXFFK

SEQ ID NO: 90 - protein, 5 aa, Artificial Sequence
  Description of Artificial Sequence: Synthetic peptide
  MOD_RES (1)..(1): Dmt
  MOD_RES (2)..(2): Tic
  MOD_RES (5)..(5): Lys(C12-Glucuronyl)
  C-term amide
YXFFK

SEQ ID NO: 91 - protein, 5 aa, Artificial Sequence
  Description of Artificial Sequence: Synthetic peptide
  MOD_RES (1)..(1): Dmt
  MOD_RES (2)..(2): Tic
  MOD_RES (5)..(5): Lys(C8-Glucuronyl)
  C-term amide
YXFFK

SEQ ID NO: 92 - protein, 5 aa, Artificial Sequence
  Description of Artificial Sequence: Synthetic peptide
  MOD_RES (1)..(1): Dmt
  MOD_RES (2)..(2): Tic
  MOD_RES (5)..(5): Lys(C10-Glucuronyl)
  C-term amide
YXFFK

SEQ ID NO: 93 - protein, 5 aa, Artificial Sequence
  Description of Artificial Sequence: Synthetic peptide
  MOD_RES (1)..(1): Dmt
  MOD_RES (2)..(2): Tic
  MOD_RES (5)..(5): Lys(C16-Glucuronyl)
  C-term amide
YXFFK

SEQ ID NO: 94 - protein, 5 aa, Artificial Sequence
  Description of Artificial Sequence: Synthetic peptide
  MOD_RES (1)..(1): Dmt
  MOD_RES (2)..(2): Tic
  MOD_RES (5)..(5): Lys(C18-Glucuronyl)
  C-term amide
YXFFK

SEQ ID NO: 95 - protein, 5 aa, Artificial Sequence
  Description of Artificial Sequence: Synthetic peptide
  MOD_RES (1)..(1): Dmt
  MOD_RES (2)..(2): Tic
  MOD_RES (5)..(5): Lys(C20-Glucuronyl)
  C-term amide
YXFFK

SEQ ID NO: 96 - protein, 5 aa, Artificial Sequence
  Description of Artificial Sequence: Synthetic peptide
  MOD_RES (1)..(1): Dmt
  MOD_RES (2)..(2): Tic
  MOD_RES (5)..(5): Lys(C22-Glucuronyl)
  C-term amide
YXFFK

SEQ ID NO: 97 - protein, 5 aa, Artificial Sequence
  Description of Artificial Sequence: Synthetic peptide
  MOD_RES (1)..(1): Dmt
  MOD_RES (2)..(2): Tic
  MOD_RES (5)..(5): Lys(C24-Glucuronyl)
  C-term amide
YXFFK

SEQ ID NO: 98 - protein, 5 aa, Artificial Sequence
  Description of Artificial Sequence: Synthetic peptide
  MOD_RES (1)..(1): Dmt
  MOD_RES (2)..(2): Tic
  MOD_RES (5)..(5): Lys(OPEG2k-Glucuronyl)
  C-term amide
YXFFK

SEQ ID NO: 99 - protein, 5 aa, Artificial Sequence
  Description of Artificial Sequence: Synthetic peptide
  MOD_RES (1)..(1): Dmt
  MOD_RES (2)..(2): Tic
  MOD_RES (5)..(5): Lys(OPEG30k-Glucuronyl)
  C-term amide
YXFFK

SEQ ID NO: 100 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C1-Glucuronyl)
  MOD_RES (5)..(5): Aib
  C-term amide
YXFKX

SEQ ID NO: 101 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C8-Glucuronyl)
  MOD_RES (5)..(5): Aib
  C-term amide
YXFKX

SEQ ID NO: 102 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C10-Glucuronyl)
  MOD_RES (5)..(5): Aib
  C-term amide
YXFKX

SEQ ID NO: 103 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C12-Glucuronyl)
  MOD_RES (5)..(5): Aib
  C-term amide
YXFKX

SEQ ID NO: 104 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C16-Glucuronyl)
  MOD_RES (5)..(5): Aib
  C-term amide
YXFKX

SEQ ID NO: 105 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C1-Glucuronyl)
  MOD_RES (5)..(5): Ac5c
  C-term amide
YXFKX

SEQ ID NO: 106 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C8-Glucuronyl)
  MOD_RES (5)..(5): Ac5c
  C-term amide
YXFKX

SEQ ID NO: 107 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C10-Glucuronyl)
  MOD_RES (5)..(5): Ac5c
  C-term amide
YXFKX

SEQ ID NO: 108 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C12-Glucuronyl)
  MOD_RES (5)..(5): Ac5c
  C-term amide
YXFKX

SEQ ID NO: 109 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C16-Glucuronyl)
  MOD_RES (5)..(5): Ac5c
  C-term amide
YXFKX

SEQ ID NO: 110 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C1-Glucuronyl)
  MOD_RES (5)..(5): Aib
  C-term amide
YXFKX

SEQ ID NO: 111 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C8-Glucuronyl)
  MOD_RES (5)..(5): Aib
  C-term amide
YXFKX

SEQ ID NO: 112 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C10-Glucuronyl)
  MOD_RES (5)..(5): Aib
  C-term amide
YXFKX

SEQ ID NO: 113 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C12-Glucuronyl)
  MOD_RES (5)..(5): Aib
  C-term amide
YXFKX

SEQ ID NO: 114 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C16-Glucuronyl)
  MOD_RES (5)..(5): Aib
  C-term amide
YXFKX

SEQ ID NO: 115 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C1-Glucuronyl)
  MOD_RES (5)..(5): Aib
  C-term NH2
YXFKX

SEQ ID NO: 116 - protein, 5 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C8-Glucuronyl)
  MOD_RES (5)..(5): Aib
  C-term NH2
YXFKX

SEQ ID NO: 117 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C10-Glucuronyl)
  C-term NH2
YXFK

SEQ ID NO: 118 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C12-Glucuronyl)
  C-term NH2
YXFK

SEQ ID NO: 119 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C16-Glucuronyl)
  C-term NH2
YXFK

SEQ ID NO: 120 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C1-Glucuronyl)
  C-term NH-CH2-Ph
YXFK

SEQ ID NO: 121 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C8-Glucuronyl)
  C-term NH-CH2-Ph
YXFK

SEQ ID NO: 122 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C10-Glucuronyl)
  C-term NH-CH2-Ph
YXFK

SEQ ID NO: 123 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C12-Glucuronyl)
  C-term NH-CH2-Ph
YXFK

SEQ ID NO: 124 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C16-Glucuronyl)
  C-term NH-CH2-Ph
YXFK

SEQ ID NO: 125 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C1-Glucuronyl)
  C-term NH-CH2-Ph-F
YXFK

SEQ ID NO: 126 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C8-Glucuronyl)
  C-term NH-CH2-Ph-F
YXFK

SEQ ID NO: 127 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C10-Glucuronyl)
  C-term NH-CH2-Ph-F
YXFK

SEQ ID NO: 128 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C12-Glucuronyl)
  C-term NH-CH2-Ph-F
YXFK

SEQ ID NO: 129 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C16-Glucuronyl)
  C-term NH-CH2-Ph-F
YXFK

SEQ ID NO: 130 - protein, 4 aa, Artificial Sequence
  Description of Artificial Sequence: Synthetic peptide
  MOD_RES (1)..(1): Dmt
  MOD_RES (2)..(2): D-Lys(C1-Glucuronyl)
  MOD_RES (4)..(4): Aib
  C-term NH2
YKFX

SEQ ID NO: 131 - protein, 4 aa, Artificial Sequence
  Description of Artificial Sequence: Synthetic peptide
  MOD_RES (1)..(1): Dmt
  MOD_RES (2)..(2): D-Lys(C8-Glucuronyl)
  MOD_RES (4)..(4): Aib
  C-term NH2
YKFX

SEQ ID NO: 132 - protein, 4 aa, Artificial Sequence
  Description of Artificial Sequence: Synthetic peptide
  MOD_RES (1)..(1): Dmt
  MOD_RES (2)..(2): D-Lys(C10-Glucuronyl)
  MOD_RES (4)..(4): Aib
  C-term NH2
YKFX

SEQ ID NO: 133 - protein, 4 aa, Artificial Sequence
  Description of Artificial Sequence: Synthetic peptide
  MOD_RES (1)..(1): Dmt
  MOD_RES (2)..(2): D-Lys(C12-Glucuronyl)
  MOD_RES (4)..(4): Aib
  C-term NH2
YKFX

SEQ ID NO: 134 - protein, 4 aa, Artificial Sequence
  Description of Artificial Sequence: Synthetic peptide
  MOD_RES (1)..(1): Dmt
  MOD_RES (2)..(2): D-Lys(C16-Glucuronyl)
  MOD_RES (4)..(4): Aib
  C-term NH2
YKFX

SEQ ID NO: 135 - protein, 5 aa, Artificial Sequence
  Description of Artificial Sequence: Synthetic peptide
  MOD_RES (1)..(1): Dmt
  MOD_RES (4)..(4): Lys(C1-Glucuronyl)
  MOD_RES (5)..(5): Aib
  C-term amide
YPFKX

SEQ ID NO: 136 - protein, 5 aa, Artificial Sequence
  Description of Artificial Sequence: Synthetic peptide
  MOD_RES (1)..(1): Dmt
  MOD_RES (4)..(4): Lys(C8-Glucuronyl)
  MOD_RES (5)..(5): Aib
  C-term amide
YPFKX

SEQ ID NO: 137 - protein, 5 aa, Artificial Sequence
  Description of Artificial Sequence: Synthetic peptide
  MOD_RES (1)..(1): Dmt
  MOD_RES (4)..(4): Lys(C10-Glucuronyl)
  MOD_RES (5)..(5): Aib
  C-term amide
YPFKX

SEQ ID NO: 138 - protein, 5 aa, Artificial Sequence
  Description of Artificial Sequence: Synthetic peptide
  MOD_RES (1)..(1): Dmt
  MOD_RES (4)..(4): Lys(C12-Glucuronyl)
  MOD_RES (5)..(5): Aib
  C-term amide
YPFKX

SEQ ID NO: 139 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C1-Glucuronyl)
  C-term NH-CH2-Ph
YXFK

SEQ ID NO: 140 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C8-Glucuronyl)
  C-term NH-CH2-Ph
YXFK

SEQ ID NO: 141 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C10-Glucuronyl)
  C-term NH-CH2-Ph
YXFK

SEQ ID NO: 142 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C12-Glucuronyl)
  C-term NH-CH2-Ph
YXFK

SEQ ID NO: 143 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C16-Glucuronyl)
  C-term NH-CH2-Ph
YXFK

SEQ ID NO: 144 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C1-Glucuronyl)
  C-term NH-CH2-Ph-F
YXFK

SEQ ID NO: 145 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C8-Glucuronyl)
  C-term NH-CH2-Ph-F
YXFK

SEQ ID NO: 146 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C10-Glucuronyl)
  C-term NH-CH2-Ph-F
YXFK

SEQ ID NO: 147 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): D-Lys(C12-Glucuronyl)
  C-term NH-CH2-Ph-F
YXFK

SEQ ID NO: 148 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C16-Glucuronyl)
  C-term NH-CH2-Ph-F
YXFK

SEQ ID NO: 149 - protein, 5 aa, Artificial Sequence
  Description of Artificial Sequence: Synthetic peptide
  MOD_RES (1)..(1): Tyr, Dmt, Nalpha-Me-Tyr, Nalpha-Me-Tyr, N,Nalpha-diMe-Tyr, or N,Nalpha-diMe-Dmt
  MOD_RES (2)..(2): Pro, D-Arg, D-Cit, D-U(X), D-Ala, Tic or Tic(Psi[CH2-NH]); wherein U is a dibasic natural or unnatural amino acid and X is a surfactant of the 1-alkyl glycoside class
  MOD_RES (3)..(3): Phe, Trp, Tmp, D-or L-Nal(1), D-or L-Nal(2), CalphaMePhe, or Psi-Phe
  MOD_RES (4)..(4): Phe, Tmp, D-or L-Nal(1), D-or L-Nal(2), U(X), D- or L-CalphaMeU(X); wherein U is a dibasic natural or unnatural amino acid and X is a surfactant of the 1-alkyl glycoside class
  MOD_RES (5)..(5): Absent or Pro, Aib, U(X), D- or L-CalphaMeU(X); wherein U is a dibasic natural or unnatural amino acid and X is a surfactant of the 1-alkyl glycoside class
  C-term NH2
  see specification as filed for detailed description of substitutions and preferred embodiments
XXXXX

SEQ ID NO: 150 - protein, 5 aa, Artificial Sequence
  Description of Artificial Sequence: Synthetic peptide
  MOD_RES (1)..(1): Dmt
  MOD_RES (2)..(2): Pro, D-Lys(X), Tic or Tic(Psi[CH2-NH]); wherein "X" is comprised of 1-alkyl glucuronic acid or 1-alkyl diglucuronic acid
  MOD_RES (3)..(3): Phe, Tmp, D-or L-Nal(1), D-or L-Nal(2) or Psi-Phe
  MOD_RES (4)..(4): Phe, D-or L-Nal(1), D-or L-Nal(2) or Lys(X); wherein "X" is comprised of 1-alkyl glucuronic acid or 1-alkyl diglucuronic acid
  MOD_RES (5)..(5): Absent or Pro, Aib, Lys(X), D- or L-CalphaMeLys(X); wherein "X" is comprised of 1-alkyl glucuronic acid or 1-alkyl diglucuronic acid
  C-term NH2
  see specification as filed for detailed description of substitutions and preferred embodiments
YXXXX

SEQ ID NO: 151 - protein, 5 aa, Artificial Sequence
  Description of Artificial Sequence: Synthetic peptide
  MOD_RES (1)..(1): Dmt
  MOD_RES (3)..(3): Phe or Tmp
  MOD_RES (4)..(4): Phe or Lys(X); wherein "X" is a surfactant
  MOD_RES (5)..(5): Absent or Aib, Lys(X), D- or L-CalphaMeLys(X); wherein "X" is a surfactant
  C-term OH or NH2
  see specification as filed for detailed description of substitutions and preferred embodiments
YPXXX

SEQ ID NO: 152 - protein, 5 aa, Artificial Sequence
  Description of Artificial Sequence: Synthetic peptide
  MOD_RES (1)..(1): Dmt
  MOD_RES (3)..(3): Phe or Tmp
  MOD_RES (4)..(4): Phe or Lys(X); wherein "X" is a surfactant
  MOD_RES (5)..(5): Absent or Lys(X); wherein "X" is a surfactant
  C-term OH or NH2
  see specification as filed for detailed description of substitutions and preferred embodiments
YPXXX

SEQ ID NO: 153 - protein, 5 aa, Artificial Sequence
  Description of Artificial Sequence: Synthetic peptide
  MOD_RES (1)..(1): Tyr, Dmt, N-R3-Tyr, N- R3-Tyr, N-(R3)2-Tyr or N-(R3)2-Dmt
  MOD_RES (2)..(2): D-Arg, D-Cit or D-U(X); wherein "U" is a dibasic, natural or unnatural amino acid and "X" is a surfactant of the 1-alkyl glycoside class
  MOD_RES (3)..(3): Phe, Trp, D-or L-Nal(1), D-or L-Nal(2) or Tmp
  MOD_RES (4)..(4): Phe, Tmp, D-or L-Nal(1), D-or L-Nal(2), U(X), D- or L-CalphaMeU(X); wherein "U" is a dibasic, natural or unnatural amino acid and "X" is a surfactant of the 1-alkyl glycoside class
  MOD_RES (5)..(5): Absent, Pro or U(X); wherein "U" is a dibasic, natural or unnatural amino acid and "X" is a surfactant of the 1-alkyl glycoside class
  C-term OH or NH2
  see specification as filed for detailed description of substitutions and preferred embodiments
XXXXX

SEQ ID NO: 154 - protein, 5 aa, Artificial Sequence
  Description of Artificial Sequence: Synthetic peptide
  MOD_RES (1)..(1): Dmt, Nalpha-Me-Dmt or N,Nalpha-Me-Dmt
  MOD_RES (2)..(2): D-Arg, D-Cit, D-Lys(X) or D-Orn(X); wherein "X" is a surfactant of the 1-alkyl glucuronic acid or 1-alkyl diglucuronic acid class
  MOD_RES (3)..(3): Phe or Tmp
  MOD_RES (4)..(4): Phe, Tmp, Lys(X) or Orn(X); wherein "X" is a surfactant of the 1-alkyl glucuronic acid or 1-alkyl diglucuronic acid class
  MOD_RES (5)..(5): Absent or Pro, Lys(X) or Orn(X); wherein "X" is a surfactant of the 1-alkyl glucuronic acid or 1-alkyl diglucuronic acid class
  C-term OH or NH2
  see specification as filed for detailed description of substitutions and preferred embodiments
XXXXX

SEQ ID NO: 155 - protein, 5 aa, Artificial Sequence
  Description of Artificial Sequence: Synthetic peptide
  MOD_RES (1)..(1): Tyr, Dmt, N-R3-Tyr, N-R3-Dmt, N-(R3)2-Tyr or N-(R3)2-Dmt
  MOD_RES (2)..(2): Tic or Tic(Psi[CH2-NH])
  MOD_RES (3)..(3): Psi-Phe
  MOD_RES (4)..(4): Phe, Tmp, D-or L-Nal(1), D-or L-Nal(2) or U(X); wherein "U" is a dibasic natural or unnatural amino acid and "X" is a surfactant of the 1-alkyl glycoside class
  MOD_RES (5)..(5): Absent, Pro, Aib or U(X); wherein "U" is a dibasic natural or unnatural amino acid and "X" is a surfactant of the 1-alkyl glycoside class
  C-term NH2
  see specification as filed for detailed description of substitutions and preferred embodiments
XXFXX

SEQ ID NO: 156 - protein, 5 aa, Artificial Sequence
  Description of Artificial Sequence: Synthetic peptide
  MOD_RES (1)..(1): Tyr, Dmt, Nalpha-Me-Tyr, Nalpha-alkyl-Dmt, N,Nalpha-diMe- Tyr or N,Nalpha-Me-Dmt
  MOD_RES (2)..(2): Tic or Tic(Psi[CH2-NH])
  MOD_RES (3)..(3): Psi-Phe
  MOD_RES (4)..(4): Phe, Tmp, D-or L-Nal(1), D-or L-Nal(2), Lys(X) or Orn(X); wherein "X" is a surfactant of the 1-alkyl glucuronic acid or 1-alkyl diglucuronic acid class
  MOD_RES (5)..(5): Absent or Aib, Lys(X) or Orn(X); wherein "X" is a surfactant of the 1-alkyl glucuronic acid or 1-alkyl diglucuronic acid class
  C-term OH or NH2
  see specification as filed for detailed description of substitutions and preferred embodiments
XXFXX

SEQ ID NO: 157 - protein, 4 aa, Artificial Sequence
  Description of Artificial Sequence: Synthetic peptide
  MOD_RES (1)..(1): Tyr, Dmt, N-R3-Tyr, N-R3-Dmt, N-(R3)2-Tyr or N-(R3)2-Dmt
  MOD_RES (2)..(2): Tic or Tic(Psi[CH2-NH])
  MOD_RES (3)..(3): Phe or Psi-Phe
  MOD_RES (4)..(4): Lys(X); wherein "X" is comprised of 1-alkyl glucuronic acid or 1-alkyl diglucuronic acid
  C-term OH or NH2
  see specification as filed for detailed description of substitutions and preferred embodiments
XXKX

SEQ ID NO: 158 - protein, 4 aa, Artificial Sequence
  Description of Artificial Sequence: Synthetic peptide
  MOD_RES (1)..(1): Tyr, Dmt, N-R3-Tyr, N-R3-Dmt, N-(R3)2-Tyr or N-(R3)2-Dmt
  MOD_RES (2)..(2): Tic
  MOD_RES (4)..(4): Lys(X); wherein "X" is comprised of 1-alkyl glucuronic acid
  C-term OH or NH2
  see specification as filed for detailed description of substitutions and preferred embodiments
XXFK

SEQ ID NO: 159 - protein, 4 aa, Artificial Sequence
  Description of Artificial Sequence: Synthetic peptide
  MOD_RES (1)..(1): Tyr, Dmt, N-R3-Tyr, N-R3-Dmt, N-(R3)2-Tyr or N-(R3)2-Dmt
  MOD_RES (2)..(2): Tic
  MOD_RES (4)..(4): Lys(X); wherein "X" is comprised of a 1-alkyl glucuronic acid
  C-term OH or NH2
  see specification as filed for detailed description of substitutions and preferred embodiments
XXFK

SEQ ID NO: 160 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(Nepsilon-1-tetradecyl beta-D-glucuronyl)
  C-term NH2
YXFK

SEQ ID NO: 161 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(N-epsilon-acetyl)
  C-term NH2
YXFK

SEQ ID NO: 162 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(N-epsilon-dodecanoyl)
  C-term NH2
YXFK

SEQ ID NO: 163 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(N-epsilon-tetradecanoyl)
  C-term NH2
YXFK

SEQ ID NO: 164 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(N-epsilon-(gamma-glutamyl)-N-alpha-dodecanoyl))
  C-term NH2
YXFK

SEQ ID NO: 165 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(N-epsilon-(gamma-glutamyl)-N-alpha-tetradecanoyl))
  C-term NH2
YXFK

SEQ ID NO: 166 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(N-epsilon-acetyl)
  C-term NH-benzyl
YXFK

SEQ ID NO: 167 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(N-epsilon-dodecanoyl)
  C-term NH-benzyl
YXFK

SEQ ID NO: 168 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Cys(S-(3-(PEG4-aminoethylacetamide-cholesterol)))
  C-term NH2
YXFC

SEQ ID NO: 169 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Cys(S-(3-(PEG4-aminoethylacetamide-cholesterol)))
  C-term NH-benzyl
YXFC

SEQ ID NO: 170 - protein, 26 aa, Artificial Sequence
  Description of Artificial Sequence: Synthetic peptide
  MOD_RES (1)..(1): Aib, Ac5c or Deg
  MOD_RES (3)..(3): Aib, Ac4c or Deg
  MOD_RES (5)..(5): His or Ile
  MOD_RES (6)..(6): Gln or Cit
  MOD_RES (7)..(7): Leu or Phe
  MOD_RES (8)..(8): Leu or Nle
  MOD_RES (10)..(10): Asp, Asn, Gln, Glu, Cit, Ala or Aib
  MOD_RES (11)..(11): Arg or hArg
  MOD_RES (12)..(12): Gly, Glu, Lys, Ala, Aib or Ac5c
  MOD_RES (13)..(13): Lys or Arg
  MOD_RES (14)..(14): Ser, His, Trp, Phe, Leu, Arg, Lys, Glu or Nal(2)
  MOD_RES (15)..(15): Ile, Leu or Aib
  MOD_RES (16)..(16): Gln, Asn, Glu, Lys, Ser, Cit, Aib or U; wherein "U" is a natural or unnatural amino acid comprising a functional group used for covalent attachment to the surfactant X
  MOD_RES (17)..(17): Asp, Ser, Aib, Ac4c, Ac5c or U; wherein "U" is a natural or unnatural amino acid comprising a functional group used for covalent attachment to the surfactant X
  MOD_RES (18)..(18): Absent or Leu, Gln, Cit, Aib, Ac5c, Lys, Glu or U; wherein "U" is a natural or unnatural amino acid comprising a functional group used for covalent attachment to the surfactant X
  MOD_RES (19)..(19): Absent or Arg, Glu, Aib, Ac4c, Ac5c or U; wherein "U" is a natural or unnatural amino acid comprising a functional group used for covalent attachment to the surfactant X
  MOD_RES (20)..(20): Absent or Arg, Glu, Lys, Aib, Ac4c, Ac5c or U; wherein "U" is a natural or unnatural amino acid comprising a functional group used for covalent attachment to the surfactant X
  MOD_RES (21)..(21): Absent or Arg, Val, Aib, Ac5C, Deg or U; wherein "U" is a natural or unnatural amino acid comprising a functional group used for covalent attachment to the surfactant X
  MOD_RES (22)..(22): Absent or Phe, Glu, Aib, Ac5C, Lys or U; wherein "U" is a natural or unnatural amino acid comprising a functional group used for covalent attachment to the surfactant X
  MOD_RES (23)..(23): Absent or Leu, Phe, Trp or U; wherein "U" is a natural or unnatural amino acid comprising a functional group used for covalent attachment to the surfactant X
  MOD_RES (24)..(24): Absent or His, Arg or U; wherein "U" is a natural or unnatural amino acid comprising a functional group used for covalent attachment to the surfactant X
  MOD_RES (25)..(25): Absent or His, Lys or U; wherein "U" is a natural or unnatural amino acid comprising a functional group used for covalent attachment to the surfactant X
  MOD_RES (26)..(26): Absent or Aib, Ac5c or Lys
  C-term OH, or -NH-R3, wherein "R3" is H, a substituted or unsubstituted C1-C12 alkyl, or a PEG chain of less than 10 Da
  see specification as filed for detailed description of substitutions and preferred embodiments
XVXEXXXXHXXXXXXXXXXXXXXXXX

SEQ ID NO: 171 - protein, 26 aa, Artificial Sequence
  Description of Artificial Sequence: Synthetic peptide
  MOD_RES (1)..(1): Aib or Ac5c
  MOD_RES (3)..(3): Aib
  MOD_RES (8)..(8): Nle
  MOD_RES (12)..(12): Ala, Glu, Lys, Aib or Ac5c
  MOD_RES (14)..(14): Trp, Phe, Lys, Glu or Nal(2)
  MOD_RES (16)..(16): Gln, Asn, Glu, Lys, Cit or U(X); wherein "U(X)" is any linker amino acid covalently attached to the surfactant X
  MOD_RES (17)..(17): Asp, Ser, Aib, Ac4c, Ac5C or U(X); wherein "U(X)" is any linker amino acid covalently attached to the surfactant X
  MOD_RES (18)..(18): Absent or Leu, Gln, Aib, Lys, Glu or U(X); wherein "U(X)" is any linker amino acid covalently attached to the surfactant X
  MOD_RES (19)..(19): Absent or Arg, Glu, Aib, Ac4c or Ac5c
  MOD_RES (20)..(20): Absent or Arg, Glu, Lys, Aib, Ac4c, Ac5c
  MOD_RES (21)..(21): Absent or Arg, Val, Aib, Ac5C or Deg
  MOD_RES (22)..(22): Absent or Phe, Glu, Lys or U(X); wherein "U(X)" is any linker amino acid covalently attached to the surfactant X
  MOD_RES (23)..(23): Absent or Leu, Phe, Trp or U(X); wherein "U(X)" is any linker amino acid covalently attached to the surfactant X
  MOD_RES (24)..(24): Absent or His, Arg or U(X); wherein "U(X)" is any linker amino acid covalently attached to the surfactant X
  MOD_RES (25)..(25): Absent or His, Lys or U(X); wherein "U(X)" is any linker amino acid covalently attached to the surfactant X
  MOD_RES (26)..(26): Absent or Aib or Ac5c
  C-term may be OH or NH2
  see specification as filed for detailed description of substitutions and preferred embodiments
XVXEIQLLHQRXRXIXXXXXXXXXXX

SEQ ID NO: 172 - protein, 36 aa, Artificial Sequence
  Description of Artificial Sequence: Synthetic polypeptide
  MOD_RES (1)..(1): Ala, Ser, Val, Pro, Aib, Ac5c or Deg
  MOD_RES (3)..(3): Ser, Ala, Aib, Ac4c or Deg
  MOD_RES (5)..(5): His or Ile
  MOD_RES (6)..(6): Gln or Cit
  MOD_RES (7)..(7): Leu or Phe
  MOD_RES (8)..(8): Leu, Met or Nle
  MOD_RES (10)..(10): Asp, Asn, Gln, Glu, Cit, Ala or Aib
  MOD_RES (11)..(11): Lys, Leu, Ile, Arg or hArg
  MOD_RES (12)..(12): Gly, Ala, Glu, Lys, Aib or Ac5c
  MOD_RES (13)..(13): Lys or Arg
  misc_feature (14)..(18): May or may not be cyclic
  MOD_RES (14)..(14): Ser, His, Trp, Phe, Leu, Arg, Lys, Glu or Nal(2)
  MOD_RES (15)..(15): Ile, Leu, Aib
  MOD_RES (16)..(16): Gln, Asn, Glu, Lys, Ser, Cit, Aib, Ac5c or U(X); wherein "U" is any linking amino acid and "X" is a surfactant- linked to the side chain of "U"
  MOD_RES (17)..(17): Asp, Ser, Aib, Ac4c, Ac5c or U(X); wherein "U" is any linking amino acid and "X" is a surfactant-linked to the side chain of "U"
  misc_feature (18)..(22): May or may not be cyclic
  MOD_RES (18)..(18): Absent or Leu, Gln, Cit, Aib, Ac5c, Lys, Glu or U(X); wherein "U" is any linking amino acid and "X" is a surfactant-linked to the side chain of "U"
  MOD_RES (19)..(19): Absent, Arg, Glu, Aib, Ac4c, Ac5c or U(X); wherein "U" is any linking amino acid and "X" is a surfactant-linked to the side chain of "U"
  MOD_RES (20)..(20): Absent or Arg, Glu, Lys, Aib, Ac4c, Ac5c or U(X); wherein "U" is any linking amino acid and "X" is a surfactant- linked to the side chain of "U"
  MOD_RES (21)..(21): Absent or Arg, Val, Aib, Ac5c, Deg or U(X); wherein "U" is any linking amino acid and "X" is a surfactant-linked to the side chain of "U"
  misc_feature (22)..(26): May or may not be cyclic
  MOD_RES (22)..(22): Absent or Phe, Glu, Aib, Ac5c, Lys, U(X); wherein "U" is any linking amino acid and "X" is a surfactant-linked to the side chain of "U"
  MOD_RES (23)..(23): Absent or Leu, Phe, Trp or U(X); wherein "U" is any linking amino acid and "X" is a surfactant-linked to the side chain of "U"
  MOD_RES (24)..(24): Absent or His, Arg, Leu, Aib, Ac5c or U(X); wherein "U" is any linking amino acid and "X" is a surfactant-linked to the side chain of "U"
  MOD_RES (25)..(25): Absent or His, Lys, Arg or U(X); wherein "U" is any linking amino acid and "X" is a surfactant-linked to the side chain of "U"
  MOD_RES (26)..(26): Absent or His, Lys, Arg, Aib or Ac5c
  MOD_RES (27)..(27): Absent or Leu or Lys
  MOD_RES (28)..(28): Absent or Ile or Lys
  MOD_RES (29)..(29): Absent or Ala, Gln, Cit or Aib
  MOD_RES (30)..(30): Absent or Glu, Asp or Aib
  MOD_RES (31)..(31): Absent or Ile, Val, Aib, Ac5C or U(X); wherein "U" is any linking amino acid and "X" is a surfactant-linked to the side chain of "U"
  MOD_RES (32)..(32): Absent or His, Aib, Ac5C or U(X); wherein "U" is any linking amino acid and "X" is a surfactant-linked to the side chain of "U"
  MOD_RES (33)..(33): Absent or Thr, Asn, Aib, Ac5C or U(X); wherein "U" is any linking amino acid and "X" is a surfactant-linked to the side chain of "U"
  MOD_RES (34)..(34): Absent or Ala, Phe, Aib, Ac5C or U(X); wherein "U" is any linking amino acid and "X" is a surfactant-linked to the side chain of "U"
  MOD_RES (35)..(35): Absent or Aib, Ac5C or U(X); wherein "U" is any linking amino acid and "X" is a surfactant-linked to the side chain of "U"
  MOD_RES (36)..(36): Absent or Aib, Ac5C or U(X); wherein "U" is any linking amino acid and "X" is a surfactant-linked to the side chain of "U"
  C-term OH, or -NH-R3, wherein "R3" is H or C1-C12 alkyl or a PEG chain of less than 10 Da
  see specification as filed for detailed description of substitutions and preferred embodiments
XVXEXXXXHXXXXXXXXXXXXXXXXXXXXXXXXXXX

SEQ ID NO: 173 - protein, 26 aa, Artificial Sequence
  Description of Artificial Sequence: Synthetic peptide
  MOD_RES (1)..(1): Aib, Ac5c or Deg
  MOD_RES (3)..(3): Aib, Ac4c or Deg
  MOD_RES (5)..(5): His or Ile
  MOD_RES (6)..(6): Gln or Cit
  MOD_RES (7)..(7): Leu or Phe
  MOD_RES (8)..(8): Leu or Nle
  MOD_RES (10)..(10): Asp, Asn, Gln, Glu, Cit, Ala or Aib
  MOD_RES (11)..(11): Arg or hArg
  MOD_RES (12)..(12): Gly, Ala, Glu, Lys, Aib or Ac5c
  MOD_RES (13)..(13): Lys or Arg
  MOD_RES (14)..(14): Ser, His, Trp, Phe, Leu, Arg, Lys or Nal(2)
  MOD_RES (15)..(15): Ile, Leu or Aib
  MOD_RES (16)..(16): Gln, Asn, Glu, Lys, Ser, Cit, Aib or U(X); wherein "U" is any linking amino acid and "X" is a surfactant from the 1-alkyl glycoside linked to "U"
  MOD_RES (17)..(17): Asp, Ser, Aib, Ac4c, Ac5c or U(X); wherein "U" is any linking amino acid and "X" is a surfactant from the 1-alkyl glycoside linked to "U"
  MOD_RES (18)..(18): Absent or Leu, Gln, Cit, Aib, Ac5c, Lys, Glu or U(X); wherein "U" is any linking amino acid and "X" is a surfactant from the 1-alkyl glycoside linked to "U"
  MOD_RES (19)..(19): Absent or Arg, Glu, Aib, Ac4c, Ac5c or U(X); wherein "U" is any linking amino acid and "X" is a surfactant from the 1-alkyl glycoside linked to "U"
  MOD_RES (20)..(20): Absent or Arg, Glu, Lys, Aib, Ac4c, Ac5c or U(X); wherein "U" is any linking amino acid and "X" is a surfactant from the 1-alkyl glycoside linked to "U"
  MOD_RES (21)..(21): Absent or Arg, Val, Aib, Ac5C, Deg or U(X); wherein "U" is any linking amino acid and "X" is a surfactant from the 1-alkyl glycoside linked to "U"
  MOD_RES (22)..(22): Absent or Phe, Glu, Lys or U(X); wherein "U" is any linking amino acid and "X" is a surfactant from the 1-alkyl glycoside linked to "U"
  MOD_RES (23)..(23): Absent or Leu, Phe, Trp or U(X); wherein "U" is any linking amino acid and "X" is a surfactant from the 1-alkyl glycoside linked to "U"
  MOD_RES (24)..(24): Absent or Leu, His, Arg or U(X); wherein "U" is any linking amino acid and "X" is a surfactant from the 1-alkyl glycoside linked to "U"
  MOD_RES (25)..(25): Absent or His, Lys or U(X); wherein "U" is any linking amino acid and "X" is a surfactant from the 1-alkyl glycoside linked to "U"
  MOD_RES (26)..(26): Absent or Aib, Ac5c
  C-term OH, or -NH-R3, wherein "R3" is H, C1-C12 alkyl or a PEG chain of less than 10 Da
  see specification as filed for detailed description of substitutions and preferred embodiments
XVXEXXXXHXXXXXXXXXXXXXXXXX

SEQ ID NO: 174 - protein, 26 aa, Artificial Sequence
  Description of Artificial Sequence: Synthetic peptide
  MOD_RES (1)..(1): Aib or Ac5c
  MOD_RES (3)..(3): Aib
  MOD_RES (8)..(8): Nle
  MOD_RES (11)..(11): hArg
  MOD_RES (12)..(12): Ala, Glu, Lys, Aib or Ac5c
  MOD_RES (14)..(14): Trp, Phe or Nal(2)
  MOD_RES (16)..(16): Gln, Asn, Glu, Lys, Cit or U(X); wherein "U" is any linking amino acid and "X" is a surfactant from the 1-alkyl glycoside linked to "U"
  MOD_RES (17)..(17): Asp, Ser, Aib, Ac4c, Ac5c or U(X); wherein "U" is any linking amino acid and "X" is a surfactant from the 1-alkyl glycoside linked to "U"
  MOD_RES (18)..(18): Absent or Leu, Gln, Aib or U(X); wherein "U" is any linking amino acid and "X" is a surfactant from the 1-alkyl glycoside linked to "U"
  MOD_RES (19)..(19): Absent or Arg, Glu, Aib, Ac4c, or Ac5c
  MOD_RES (20)..(20): Absent or Arg, Glu, Lys, Aib, Ac4c or Ac5c
  MOD_RES (21)..(21): Absent or Arg, Val, Aib, Ac5C or Deg
  MOD_RES (22)..(22): Absent or Phe, Glu, Lys or U(X); wherein "U" is any linking amino acid and "X" is a surfactant from the 1-alkyl glycoside linked to "U"
  MOD_RES (23)..(23): Absent or Leu, Phe, Trp or U(X); wherein "U" is any linking amino acid and "X" is a surfactant from the 1-alkyl glycoside linked to "U"
  MOD_RES (24)..(24): Absent or His, Arg or U; wherein "U" is any linking amino acid
  MOD_RES (25)..(25): Absent or His, Lys, or U; wherein "U" is any linking amino acid
  MOD_RES (26)..(26): Absent or Aib or Ac5c
  C-term OH or -NH2
  see specification as filed for detailed description of substitutions and preferred embodiments
XVXEIQLLHQRXRXIXXXXXXXXXXX

SEQ ID NO: 175 - protein, 17 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Lys(C1)
  C-term amide
XVXEIQLLHQRARFIQK

SEQ ID NO: 176 - protein, 17 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Lys(C8)
  C-term amide
XVXEIQLLHQRARFIQK

SEQ ID NO: 177 - protein, 17 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Lys(C12)
  C-term amide
XVXEIQLLHQRARFIQK

SEQ ID NO: 178 - protein, 17 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Lys(C12)
  C-term amide
XVXEIQLLHQRARWIQK

SEQ ID NO: 179 - protein, 16 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (16)..(16): Lys(C12)
  C-term amide
XVXEIQLLHQRARWIK

SEQ ID NO: 180 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C12)
  C-term amide
XVXEIQLLHQRARWIQXK

SEQ ID NO: 181 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C12)
  C-term amide
XVXEIQLLHQRARFIQXK

SEQ ID NO: 182 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C16)
  C-term amide
XVXEIQLLHQRARWIQXK

SEQ ID NO: 183 - protein, 22 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (21)..(21): Aib
  MOD_RES (22)..(22): Lys(C8)
  C-term amide
XVXEIQLLHQRARWIQDLRRXK

SEQ ID NO: 184 - protein, 22 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (21)..(21): Aib
  MOD_RES (22)..(22): Lys(C12)
  C-term amide
XVXEIQLLHQRARWIQDLRRXK

SEQ ID NO: 185 - protein, 22 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (21)..(21): Aib
  MOD_RES (22)..(22): Lys(C16)
  C-term amide
XVXEIQLLHQRARWIQDLRRXK

SEQ ID NO: 186 - protein, 17 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (17)..(17): Lys(C1)
  C-term amide
XVXEIQLLHQRXRFIQK

SEQ ID NO: 187 - protein, 17 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (17)..(17): Lys(C8)
  C-term amide
XVXEIQLLHQRXRFIQK

SEQ ID NO: 188 - skipped

SEQ ID NO: 189 - protein, 17 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (17)..(17): Lys(C12)
  C-term amide
XVXEIQLLHQRXRFIQK

SEQ ID NO: 190 - protein, 17 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (17)..(17): Lys(C12)
  C-term amide
XVXEIQLLHQRXRWIQK

SEQ ID NO: 191 - protein, 16 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (15)..(15): Aib
  MOD_RES (16)..(16): Lys(C12)
  C-term amide
XVXEIQLLHQRARWXK

SEQ ID NO: 192 - protein, 17 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (15)..(15): Aib
  MOD_RES (17)..(17): Lys(C12)
  C-term amide
XVXEIQLLHQRARWXQK

SEQ ID NO: 193 - protein, 17 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (17)..(17): Lys(C12)
  C-term amide
XVXEIQLLHQRXRWIQK

SEQ ID NO: 194 - protein, 17 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (14)..(14): Nal2
  MOD_RES (17)..(17): Lys(C12)
  C-term amide
XVXEIQLLHQRXRAIQK

SEQ ID NO: 195 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (17)..(17): Aib
  MOD_RES (18)..(18): Lys(C12)
  C-term amide
XVXEIQLLHQRXRWIQXK

SEQ ID NO: 196 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (17)..(17): Aib
  MOD_RES (18)..(18): Lys(C12)
  C-term amide
XVXEIQLLHQRXRFIQXK

SEQ ID NO: 197 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (14)..(14): Nal2
  MOD_RES (17)..(17): Aib
  MOD_RES (18)..(18): Lys(C12)
  C-term amide
XVXEIQLLHQRXRAIQXK

SEQ ID NO: 198 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (17)..(17): Aib
  MOD_RES (18)..(18): Lys(C16)
  C-term amide
XVXEIQLLHQRXRWIQXK

SEQ ID NO: 199 - protein, 22 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (21)..(21): Aib
  MOD_RES (22)..(22): Lys(C8)
  C-term amide
XVXEIQLLHQRXRWIQDLRRXK

SEQ ID NO: 200 - protein, 22 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (21)..(21): Aib
  MOD_RES (22)..(22): Lys(C12)
  C-term amide
XVXEIQLLHQRXRWIQDLRRXK

SEQ ID NO: 201 - protein, 22 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (21)..(21): Aib
  MOD_RES (22)..(22): Lys(C16)
  C-term amide
XVXEIQLLHQRXRWIQDLRRXK

SEQ ID NO: 202 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (18)..(18): Lys(C12)
  MOD_RES (19)..(19): Aib
  C-term amide
XVXEIQLLHQRXRWIQDKX

SEQ ID NO: 203 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (18)..(18): Lys(C12)
  MOD_RES (19)..(19): Aib
  C-term amide
XVXEIQLLHQRXRFIQDKX

SEQ ID NO: 204 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (18)..(18): Lys(C16)
  MOD_RES (19)..(19): Aib
  C-term amide
XVXEIQLLHQRXRWIQDKX

SEQ ID NO: 205 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (17)..(17): Lys(C12)
  MOD_RES (18)..(18): Aib
  C-term amide
XVXEIQLLHQRXRWIQKX

SEQ ID NO: 206 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Lys(C12)
  MOD_RES (18)..(18): Aib
  C-term amide
XVXEIQLLHQRARWIQKX

SEQ ID NO: 207 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C12)
  MOD_RES (19)..(19): Aib
  C-term amide
XVXEIQLLHQRARWIQXKX

SEQ ID NO: 208 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Lys(C12)
  MOD_RES (18)..(18): Aib
  C-term amide
XVXEIQLLHQRARFIQKX

SEQ ID NO: 209 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C12)
  MOD_RES (19)..(19): Aib
  C-term amide
XVXEIQLLHQRARFIQXKX

SEQ ID NO: 210 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (17)..(17): Lys(C12)
  MOD_RES (18)..(18): Aib
  C-term amide
XVXEIQLLHQRXRWIQKX

SEQ ID NO: 211 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (17)..(17): Aib
  MOD_RES (18)..(18): Lys(C12)
  MOD_RES (19)..(19): Aib
  C-term amide
XVXEIQLLHQRXRWIQXKX

SEQ ID NO: 212 - protein, 18 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (12)..(12): Aib
  MOD_RES (17)..(17): Lys(C12)
  MOD_RES (18)..(18): Aib
  C-term amide
XVXEIQLLHQRXRFIQKX

SEQ ID NO: 213 - protein, 19 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (12)..(12): Aib
  MOD_RES (17)..(17): Aib
  MOD_RES (18)..(18): Lys(C12)
  MOD_RES (19)..(19): Aib
  C-term amide
XVXEIQLLHQRXRFIQXKX

SEQ ID NO: 214 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Lys(C12)
  MOD_RES (18)..(18): Aib
  C-term amide
XVXEHQLLHQRARWIQKX

SEQ ID NO: 215 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C12)
  MOD_RES (19)..(19): Aib
  C-term amide
XVXEHQLLHQRARWIQXKX

SEQ ID NO: 216 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Lys(C12)
  MOD_RES (18)..(18): Aib
  C-term amide
XVXEHQLLHQRARFIQKX

SEQ ID NO: 217 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C12)
  MOD_RES (19)..(19): Aib
  C-term amide
XVXEHQLLHQRARFIQXKX

SEQ ID NO: 218 - protein, 18 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (17)..(17): Lys(C12)
  MOD_RES (18)..(18): Aib
  C-term amide
XVXEHQLLHQRARWIQKX

SEQ ID NO: 219 - protein, 19 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (17)..(17): Aib
  MOD_RES (18)..(18): Lys(C12)
  MOD_RES (19)..(19): Aib
  C-term amide
XVXEHQLLHQRARWIQXKX

SEQ ID NO: 220 - protein, 18 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (17)..(17): Lys(C12)
  MOD_RES (18)..(18): Aib
  C-term amide
XVXEHQLLHQRARFIQKX

SEQ ID NO: 221 - protein, 19 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (17)..(17): Aib
  MOD_RES (18)..(18): Lys(C12)
  MOD_RES (19)..(19): Aib
  C-term amide
XVXEHQLLHQRARFIQXKX

SEQ ID NO: 222 - protein, 18 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (12)..(12): Aib
  MOD_RES (17)..(17): Lys(C12)
  MOD_RES (18)..(18): Aib
  C-term amide
XVXEHQLLHQRXRWIQKX

SEQ ID NO: 223 - protein, 19 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (12)..(12): Aib
  MOD_RES (17)..(17): Aib
  MOD_RES (18)..(18): Lys(C12)
  MOD_RES (19)..(19): Aib
  C-term amide
XVXEHQLLHQRXRWIQXKX

SEQ ID NO: 224 - protein, 18 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (12)..(12): Aib
  MOD_RES (17)..(17): Lys(C12)
  MOD_RES (18)..(18): Aib
  C-term amide
XVXEHQLLHQRXRFIQKX

SEQ ID NO: 225 - protein, 19 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (12)..(12): Aib
  MOD_RES (17)..(17): Aib
  MOD_RES (18)..(18): Lys(C12)
  MOD_RES (19)..(19): Aib
  C-term amide
XVXEHQLLHQRXRFIQXKX

SEQ ID NO: 226 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (19)..(19): Lys(C12)
  MOD_RES (21)..(21): Aib
  C-term amide
XVXEIQLLHQRARWIQDLKRX

SEQ ID NO: 227 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (19)..(19): Lys(C14)
  MOD_RES (21)..(21): Aib
  C-term amide
XVXEIQLLHQRARWIQDLKRX

SEQ ID NO: 228 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (19)..(19): Lys(C16)
  MOD_RES (21)..(21): Aib
  C-term amide
XVXEIQLLHQRARWIQDLKRX

SEQ ID NO: 229 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (18)..(18): Aib
  MOD_RES (19)..(19): Lys(C12)
  MOD_RES (21)..(21): Aib
  C-term amide
XVXEIQLLHQRARWIQDXKRX

SEQ ID NO: 230 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (18)..(18): Aib
  MOD_RES (19)..(19): Lys(C14)
  MOD_RES (21)..(21): Aib
  C-term amide
XVXEIQLLHQRARWIQDXKRX

SEQ ID NO: 231 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (18)..(18): Aib
  MOD_RES (19)..(19): Lys(C16)
  MOD_RES (21)..(21): Aib
  C-term amide
XVXEIQLLHQRARWIQDXKRX

SEQ ID NO: 232 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (18)..(18): Ac5c
  MOD_RES (19)..(19): Lys(C12)
  MOD_RES (21)..(21): Aib
  C-term amide
XVXEIQLLHQRARWIQDXKRX

SEQ ID NO: 233 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (18)..(18): Ac5c
  MOD_RES (19)..(19): Lys(C14)
  MOD_RES (21)..(21): Aib
  C-term amide
XVXEIQLLHQRARWIQDXKRX

SEQ ID NO: 234 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (18)..(18): Ac5c
  MOD_RES (19)..(19): Lys(C16)
  MOD_RES (21)..(21): Aib
  C-term amide
XVXEIQLLHQRARWIQDXKRX

SEQ ID NO: 235 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (19)..(19): Lys(C12)
  MOD_RES (21)..(21): Ac5c
  C-term amide
XVXEIQLLHQRARWIQDLKRX

SEQ ID NO: 236 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (19)..(19): Lys(C14)
  MOD_RES (21)..(21): Ac5c
  C-term amide
XVXEIQLLHQRARWIQDLKRX

SEQ ID NO: 237 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (19)..(19): Lys(C16)
  MOD_RES (21)..(21): Ac5c
  C-term amide
XVXEIQLLHQRARWIQDLKRX

SEQ ID NO: 238 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (19)..(19): Lys(C14)
  MOD_RES (21)..(21): Ac5c
  C-term amide
XVXEIQLLHQRXRWIQDLKRX

SEQ ID NO: 239 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (19)..(19): Lys(C16)
  MOD_RES (21)..(21): Ac5c
  C-term amide
XVXEIQLLHQRXRWIQDLKRX

SEQ ID NO: 240 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (19)..(19): Lys(C12)
  MOD_RES (21)..(21): Ac5c
  C-term amide
XVXEIQLLHQRXRWIQDLKRX

SEQ ID NO: 241 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (19)..(19): Lys(C14)
  MOD_RES (21)..(21): Aib
  C-term amide
XVXEIQLLHQRXRWIQDLKRX

SEQ ID NO: 242 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (19)..(19): Lys(C16)
  MOD_RES (21)..(21): Aib
  C-term amide
XVXEIQLLHQRXRWIQDLKRX

SEQ ID NO: 243 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (18)..(18): Aib
  MOD_RES (19)..(19): Lys(C12)
  MOD_RES (21)..(21): Aib
  C-term amide
XVXEIQLLHQRXRWIQDXKRX

SEQ ID NO: 244 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (18)..(18): Aib
  MOD_RES (19)..(19): Lys(C14)
  MOD_RES (21)..(21): Aib
  C-term amide
XVXEIQLLHQRXRWIQDXKRX

SEQ ID NO: 245 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (18)..(18): Aib
  MOD_RES (19)..(19): Lys(C16)
  MOD_RES (21)..(21): Aib
  C-term amide
XVXEIQLLHQRXRWIQDXKRX

SEQ ID NO: 246 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (18)..(18): Ac5c
  MOD_RES (19)..(19): Lys(C12)
  MOD_RES (21)..(21): Aib
  C-term amide
XVXEIQLLHQRXRWIQDXKRX

SEQ ID NO: 247 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (18)..(18): Ac5c
  MOD_RES (19)..(19): Lys(C14)
  MOD_RES (21)..(21): Aib
  C-term amide
XVXEIQLLHQRXRWIQDXKRX

SEQ ID NO: 248 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  MOD_RES (18)..(18): Ac5c
  MOD_RES (19)..(19): Lys(C16)
  MOD_RES (21)..(21): Aib
  C-term amide
XVXEIQLLHQRXRWIQDXKRX

SEQ ID NO: 249 - protein, 21 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (19)..(19): Lys(C12)
  MOD_RES (21)..(21): Aib
  C-term amide
XVXEIQLLHQRARWIQDLKRX

SEQ ID NO: 250 - protein, 21 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (19)..(19): Lys(C14)
  MOD_RES (21)..(21): Aib
  C-term amide
XVXEIQLLHQRARWIQDLKRX

SEQ ID NO: 251 - protein, 21 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (19)..(19): Lys(C16)
  MOD_RES (21)..(21): Aib
  C-term amide
XVXEIQLLHQRARWIQDLKRX

SEQ ID NO: 252 - protein, 21 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (12)..(12): Aib
  MOD_RES (19)..(19): Lys(C12)
  MOD_RES (21)..(21): Aib
  C-term amide
XVXEIQLLHQRXRWIQDLKRX

SEQ ID NO: 253 - protein, 21 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (12)..(12): Aib
  MOD_RES (19)..(19): Lys(C14)
  MOD_RES (21)..(21): Aib
  C-term amide
XVXEIQLLHQRXRWIQDLKRX

SEQ ID NO: 254 - protein, 21 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (12)..(12): Aib
  MOD_RES (19)..(19): Lys(C16)
  MOD_RES (21)..(21): Aib
  C-term amide
XVXEIQLLHQRXRWIQDLKRX

SEQ ID NO: 255 - protein, 21 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (12)..(12): Aib
  MOD_RES (19)..(19): Lys(C12)
  MOD_RES (21)..(21): Aib
  C-term amide
XVXEIQLLHQRXRWINDLKRX

SEQ ID NO: 256 - protein, 21 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (12)..(12): Aib
  MOD_RES (19)..(19): Lys(C14)
  MOD_RES (21)..(21): Aib
  C-term amide
XVXEIQLLHQRXRWINDLKRX

SEQ ID NO: 257 - protein, 21 aa, Artificial Sequence
  Description of Artificial Sequence: Synthetic peptide
  MOD_RES (1)..(1): Ac5c
  MOD_RES (3)..(3): Aib
  MOD_RES (11)..(11): hArg
  MOD_RES (12)..(12): Aib
  MOD_RES (19)..(19): Lys(C16)
  MOD_RES (21)..(21): Aib
  C-term amide
XVXEIQLLHQRXRWINDLKRX

SEQ ID NO: 258 - protein, 21 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  misc_feature (14)..(18): Cyclic
  MOD_RES (14)..(14): Lys is cyclized through side chain to form a lactam linkage
  MOD_RES (18)..(18): Glu is cyclized through side chain to form a lactam linkage
  MOD_RES (19)..(19): Lys(C12)
  MOD_RES (21)..(21): Aib
  C-term amide
XVXEIQLLHQRARKIQDEKRX

SEQ ID NO: 259 - protein, 26 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (12)..(12): Aib
  misc_feature (18)..(22): Cyclic
  MOD_RES (18)..(18): Lys is cyclized through side chain to form a lactam linkage
  MOD_RES (22)..(22): Glu is cyclized through side chain to form a lactam linkage
  MOD_RES (25)..(25): Lys(C12)
  MOD_RES (26)..(26): Aib
  C-term amide
XVXEIQLLHQRXRWIQDKRRREFLKX

SEQ ID NO: 260 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C14)
  MOD_RES (19)..(19): Aib
  C-term amide
XVXEIQLLHQRARWIQXKX

SEQ ID NO: 261 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C16)
  MOD_RES (19)..(19): Aib
  C-term amide
XVXEIQLLHQRARWIQXKX

SEQ ID NO: 262 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C18)
  MOD_RES (19)..(19): Aib
  C-term amide
XVXEIQLLHQRARWIQXKX

SEQ ID NO: 263 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C12)
  MOD_RES (19)..(19): Aib
  C-term amide
XVXEIQLLHQRARFIQXKX

SEQ ID NO: 264 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C14)
  MOD_RES (19)..(19): Aib
  C-term amide
XVXEIQLLHQRARFIQXKX

SEQ ID NO: 265 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C16)
  MOD_RES (19)..(19): Aib
  C-term amide
XVXEIQLLHQRARFIQXKX

SEQ ID NO: 266 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C18)
  MOD_RES (19)..(19): Aib
  C-term amide
XVXEIQLLHQRARFIQXKX

SEQ ID NO: 267 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (14)..(14): Nal2
  MOD_RES (17)..(17): Aib
  MOD_RES (18)..(18): Lys(C12)
  MOD_RES (19)..(19): Aib
  C-term amide
XVXEIQLLHQRARAIQXKX

SEQ ID NO: 268 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (14)..(14): Nal2
  MOD_RES (17)..(17): Aib
  MOD_RES (18)..(18): Lys(C14)
  MOD_RES (19)..(19): Aib
  C-term amide
XVXEIQLLHQRARAIQXKX

SEQ ID NO: 269 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (14)..(14): Nal2
  MOD_RES (17)..(17): Aib
  MOD_RES (18)..(18): Lys(C16)
  MOD_RES (19)..(19): Aib
  C-term amide
XVXEIQLLHQRARAIQXKX

SEQ ID NO: 270 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (14)..(14): Nal2
  MOD_RES (17)..(17): Aib
  MOD_RES (18)..(18): Lys(C18)
  MOD_RES (19)..(19): Aib
  C-term amide
XVXEIQLLHQRARAIQXKX

SEQ ID NO: 271 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): Aib
  MOD_RES (18)..(18): Lys(C12)
  MOD_RES (19)..(19): Aib
  C-term amide
XVXEIQLLHQRERWIKXKX

SEQ ID NO: 272 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): Aib
  MOD_RES (18)..(18): Lys(C14)
  MOD_RES (19)..(19): Aib
  C-term amide
XVXEIQLLHQRERWIKXKX

SEQ ID NO: 273 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): Aib
  MOD_RES (18)..(18): Lys(C16)
  MOD_RES (19)..(19): Aib
  C-term amide
XVXEIQLLHQRERWIKXKX

SEQ ID NO: 274 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): Aib
  MOD_RES (18)..(18): Lys(C18)
  MOD_RES (19)..(19): Aib
  C-term amide
XVXEIQLLHQRERWIKXKX

SEQ ID NO: 275 - protein, 20 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C12)
  MOD_RES (19)..(20): Aib
  C-term amide
XVXEIQLLHQRARWIQXKXX

SEQ ID NO: 276 - protein, 20 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C14)
  MOD_RES (19)..(20): Aib
  C-term amide
XVXEIQLLHQRARWIQXKXX

SEQ ID NO: 277 - protein, 20 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C16)
  MOD_RES (19)..(20): Aib
  C-term amide
XVXEIQLLHQRARWIQXKXX

SEQ ID NO: 278 - protein, 20 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(C18)
  MOD_RES (19)..(20): Aib
  C-term amide
XVXEIQLLHQRARWIQXKXX

SEQ ID NO: 279 - protein, 20 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): Aib
  MOD_RES (18)..(18): Lys(C12)
  MOD_RES (19)..(20): Aib
  C-term amide
XVXEIQLLHQRERWIKXKXX

SEQ ID NO: 280 - protein, 20 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): Aib
  MOD_RES (18)..(18): Lys(C14)
  MOD_RES (19)..(20): Aib
  C-term amide
XVXEIQLLHQRERWIKXKXX

SEQ ID NO: 281 - protein, 20 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): Aib
  MOD_RES (18)..(18): Lys(C16)
  MOD_RES (19)..(20): Aib
  C-term amide
XVXEIQLLHQRERWIKXKXX

SEQ ID NO: 282 - protein, 20 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): Aib
  MOD_RES (18)..(18): Lys(C18)
  MOD_RES (19)..(20): Aib
  C-term amide
XVXEIQLLHQRERWIKXKXX

SEQ ID NO: 283 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(N-epsilon-1'-alkyl beta-D-glucuronyl)
  MOD_RES (19)..(19): Aib
  C-term NH2
  see specification as filed for detailed description of substitutions and preferred embodiments
XVXEIQLLHQRARWIQXKX

SEQ ID NO: 284 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(N-epsilon-1'-alkyl beta-D-glucuronyl)
  MOD_RES (19)..(19): Ac4c
  C-term NH2
  see specification as filed for detailed description of substitutions and preferred embodiments
XVXEIQLLHQRARWIQXKX

SEQ ID NO: 285 - protein, 20 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  misc_feature (16)..(20): Cyclic
  MOD_RES (16)..(16): Glu is cyclized through side chain to form a lactam linkage
  MOD_RES (17)..(17): Aib
  MOD_RES (18)..(18): Lys(N-epsilon-1'-alkyl beta-D-glucuronyl)
  MOD_RES (19)..(19): Aib
  MOD_RES (20)..(20): Lys is cyclized through side chain to form a lactam linkage
  C-term NH2
  see specification as filed for detailed description of substitutions and preferred embodiments
XVXEIQLLHQRARWIEXKXK

SEQ ID NO: 286 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): Aib
  MOD_RES (18)..(18): Lys(N-epsilon-1'-alkyl beta-D-glucuronyl)
  MOD_RES (19)..(19): Aib
  C-term NH2
  see specification as filed for detailed description of substitutions and preferred embodiments
XVXEIQLLHQRERWIKXKX

SEQ ID NO: 287 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(N-epsilon-1'-alkyl beta-D-glucuronyl)
  MOD_RES (19)..(19): Aib
  C-term NH2
  see specification as filed for detailed description of substitutions and preferred embodiments
XVXEIQLLHQRARFIQXKX

SEQ ID NO: 288 - protein, 20 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(N-epsilon-1'-alkyl beta-D-glucuronyl)
  MOD_RES (19)..(20): Aib
  C-term NH2
  see specification as filed for detailed description of substitutions and preferred embodiments
XVXEIQLLHQRARWIQXKXX

SEQ ID NO: 289 - protein, 20 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): Aib
  MOD_RES (18)..(18): Lys(N-epsilon-1'-alkyl beta-D-glucuronyl)
  MOD_RES (19)..(20): Aib
  C-term NH2
  see specification as filed for detailed description of substitutions and preferred embodiments
XVXEIQLLHQRERWIKXKXX

SEQ ID NO: 290 - protein, 34 aa, Unknown
  Description of Unknown: PTH hormone polypeptide analog
SVSEIQLMHNLGKHLNSMERVEWLRKKLQDVHNF

SEQ ID NO: 291 - protein, 34 aa, Unknown
  Description of Unknown: PTH hormone polypeptide analog
AVSEHQLLHDKGKSIQDLRRRFFLHHLIAEIHTA

SEQ ID NO: 292 - protein, 20 aa, Artificial Sequence
  Description of Artificial Sequence: Synthetic peptide
  MOD_RES (1)..(1): Ala, Ser, Val, Pro, Aib, Ac5c or Deg
  MOD_RES (3)..(3): Ser, Ala, Aib, Ac4c or Deg
  MOD_RES (5)..(5): His or Ile
  MOD_RES (6)..(6): Gln or Cit
  MOD_RES (7)..(7): Leu or Phe
  MOD_RES (8)..(8): Leu, Met or Nle
  MOD_RES (10)..(10): Asp, Asn, Gln, Glu, Cit, Ala or Aib
  MOD_RES (11)..(11): Lys, Leu, Ile, Arg or hArg
  MOD_RES (12)..(12): Gly, Ala, Glu, Lys, Aib or Ac5c
  MOD_RES (13)..(13): Lys or Arg
  misc_feature (14)..(18): May or may not be cyclic
  MOD_RES (14)..(14): Ser, His, Trp, Phe, Leu, Arg, Lys, Glu or Nal(2)
  MOD_RES (15)..(15): Ile, Leu, Aib
  MOD_RES (16)..(16): Gln, Asn, Glu, Lys, Ser, Cit, Aib, Ac5c or U(X); wherein "U" is any linking amino acid and "X" is a surfactant- linked to the side chain of "U"
  MOD_RES (17)..(17): Asp, Ser, Aib, Ac4c, Ac5c or U(X); wherein "U" is any linking amino acid and "X" is a surfactant-linked to the side chain of "U"
  MOD_RES (18)..(18): Absent or Leu, Gln, Cit, Aib, Ac5c, Lys, Glu or U(X); wherein "U" is any linking amino acid and "X" is a surfactant-linked to the side chain of "U"
  MOD_RES (19)..(19): Absent, Arg, Glu, Aib, Ac4c, Ac5c or U(X); wherein "U" is any linking amino acid and "X" is a surfactant-linked to the side chain of "U"
  MOD_RES (20)..(20): Absent or Arg, Glu, Lys, Aib, Ac4c, Ac5c or U(X); wherein "U" is any linking amino acid and "X" is a surfactant- linked to the side chain of "U"
  C-term OH, or -NH-R3, wherein "R3" is H or C1-C12 alkyl or a PEG chain of less than 10 Da
  see specification as filed for detailed description of substitutions and preferred embodiments
XVXEXXXXHXXXXXXXXXXX

SEQ ID NO: 293 - protein, 19 aa, Artificial Sequence
  Description of Artificial Sequence: Synthetic peptide
  MOD_RES (1)..(1): Ala, Ser, Val, Pro, Aib, Ac5c or Deg
  MOD_RES (3)..(3): Ser, Ala, Aib, Ac4c or Deg
  MOD_RES (5)..(5): His or Ile
  MOD_RES (6)..(6): Gln or Cit
  MOD_RES (7)..(7): Leu or Phe
  MOD_RES (8)..(8): Leu, Met or Nle
  MOD_RES (10)..(10): Asp, Asn, Gln, Glu, Cit, Ala or Aib
  MOD_RES (11)..(11): Lys, Leu, Ile, Arg or hArg
  MOD_RES (12)..(12): Gly, Ala, Glu, Lys, Aib or Ac5c
  MOD_RES (13)..(13): Lys or Arg
  misc_feature (14)..(18): May or may not be cyclic
  MOD_RES (14)..(14): Ser, His, Trp, Phe, Leu, Arg, Lys, Glu or Nal(2)
  MOD_RES (15)..(15): Ile, Leu, Aib
  MOD_RES (16)..(16): Gln, Asn, Glu, Lys, Ser, Cit, Aib, Ac5c or U(X); wherein "U" is any linking amino acid and "X" is a surfactant- linked to the side chain of "U"
  MOD_RES (17)..(17): Asp, Ser, Aib, Ac4c, Ac5c or U(X); wherein "U" is any linking amino acid and "X" is a surfactant-linked to the side chain of "U"
  MOD_RES (18)..(18): Absent or Leu, Gln, Cit, Aib, Ac5c, Lys, Glu or U(X); wherein "U" is any linking amino acid and "X" is a surfactant-linked to the side chain of "U"
  MOD_RES (19)..(19): Absent, Arg, Glu, Aib, Ac4c, Ac5c or U(X); wherein "U" is any linking amino acid and "X" is a surfactant-linked to the side chain of "U"
  C-term OH, or -NH-R3, wherein "R3" is H or C1-C12 alkyl or a PEG chain of less than 10 Da
  see specification as filed for detailed description of substitutions and preferred embodiments
XVXEXXXXHXXXXXXXXXX

SEQ ID NO: 294 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(N-epsilon-dodecanoyl)
  MOD_RES (19)..(19): Aib
  C-term NH2
XVXEIQLLHQRARWIQXKX

SEQ ID NO: 295 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(N-epsilon-dodecanoyl)
  C-term NH2
XVXEIQLLHQRARWIQXK

SEQ ID NO: 296 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(N-epsilon-palmitoyl)
  MOD_RES (19)..(19): Aib
  C-term NH2
XVXEIQLLHQRARWIQXKX

SEQ ID NO: 297 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(N-epsilon-dodecanoyl)
  MOD_RES (19)..(19): Aib
  C-term NH2
XVXEIQLLHQRARFIQXKX

SEQ ID NO: 298 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(N-epsilon-tetradecanoyl)
  MOD_RES (19)..(19): Aib
  C-term NH2
XVXEIQLLHQRARWIQXKX

SEQ ID NO: 299 - protein, 20 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(N-epsilon-tetradecanoyl)
  MOD_RES (19)..(20): Aib
  C-term NH2
XVXEIQLLHQRARWIQXKXX

SEQ ID NO: 300 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Lys(N-epsilon-(Nalpha-dodecanoyl-L-glutamyl))
  MOD_RES (19)..(19): Aib
  C-term NH2
XVXEIQLLHQRARWIQXKX

SEQ ID NO: 301 - protein, 19 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Cys(S-(3-(PEG4-aminoethylacetamide-Cholesterol)))
  MOD_RES (19)..(19): Aib
  C-term NH2
XVXEIQLLHQRARWIQXCX

SEQ ID NO: 302 - protein, 18 aa, Artificial Sequence
  Description of Artificial Sequence: Synthetic peptide
  MOD_RES (1)..(1): Ac5c
  MOD_RES (3)..(3): Aib
  MOD_RES (8)..(8): Nle
  MOD_RES (11)..(11): hArg
  MOD_RES (17)..(17): Aib
  MOD_RES (18)..(18): Cys(S-(3-(PEG4-aminoethylacetamide-Cholesterol)))
  C-term NH2
XVXEIQLLHQRARWIQXC

SEQ ID NO: 303 - protein, 38 aa, Artificial Sequence
  Description of Artificial Sequence: Synthetic polypeptide
  MOD_RES (1)..(1): pGlu or absent
  MOD_RES (2)..(2): His, N-Ac-His, or N-R3-His
  MOD_RES (3)..(3): Ser, Ala, Gly, Aib, Ac4c or Ac5c
  MOD_RES (4)..(4): Gln or Cit
  MOD_RES (5)..(5): Gly or D-Ala
  MOD_RES (6)..(6): Thr or Ser
  MOD_RES (7)..(7): Phe, Trp, F2Phe, Me2Phe or Nal2
  MOD_RES (8)..(8): Thr or Ser
  MOD_RES (9)..(9): Ser or Asp
  MOD_RES (10)..(10): Asp or Glu
  MOD_RES (11)..(11): Tyr, Leu, Met, Nal2, Bip or Bip2EtMeO
  MOD_RES (12)..(12): Ser, Asn or U; wherein "U" is a natural or unnatural amino acid comprising a functional group used for covalent attachment to the surfactant X
  MOD_RES (13)..(13): Lys, Glu, Ser, Arg or U; wherein "U" is a natural or unnatural amino acid comprising a functional group used for covalent attachment to the surfactant X
  MOD_RES (14)..(14): Absent or Tyr, Gln, Cit or U; wherein "U" is a natural or unnatural amino acid comprising a functional group used for covalent attachment to the surfactant X
  MOD_RES (15)..(15): Absent or Leu, Met, Nle or U; wherein "U" is a natural or unnatural amino acid comprising a functional group used for covalent attachment to the surfactant X
  MOD_RES (16)..(16): Absent or Asp, Glu or U; wherein "U" is a natural or unnatural amino acid comprising a functional group used for covalent attachment to the surfactant X
  MOD_RES (17)..(17): Absent or Ser, Gly, Glu, Aib, Ac5c, Lys, Arg or U; wherein "U" is a natural or unnatural amino acid comprising a functional group used for covalent attachment to the surfactant X
  MOD_RES (18)..(18): Absent or Arg, hArg, Gln, Glu, Cit, Aib, Ac4c, Ac5c or U; wherein "U" is a natural or unnatural amino acid comprising a functional group used for covalent attachment to the surfactant X
  MOD_RES (19)..(19): Absent or Arg, hArg, Ala, Aib, Ac4c, Ac5c or U; wherein "U" is a natural or unnatural amino acid comprising a functional group used for covalent attachment to the surfactant X
  MOD_RES (20)..(20): Absent or Ala, Val, Aib, Ac4c, Ac5c or U; wherein "U" is a natural or unnatural amino acid comprising a functional group used for covalent attachment to the surfactant X
  MOD_RES (21)..(21): Absent or Gln, Lys, Arg, Cit, Glu, Aib, Ac4c, Ac5c or U; wherein "U" is a natural or unnatural amino acid comprising a functional group used for covalent attachment to the surfactant X
  MOD_RES (22)..(22): Absent or Asp, Glu, Leu, Aib, Ac4c, Ac5c or U; wherein "U" is a natural or unnatural amino acid comprising a functional group used for covalent attachment to the surfactant X
  MOD_RES (23)..(23): Absent or Phe, Trp, Nal2, Aib, Ac4c, Ac5c or U; wherein "U" is a natural or unnatural amino acid comprising a functional group used for covalent attachment to the surfactant X
  MOD_RES (24)..(24): Absent or Val, Ile, Aib, Ac4c, Ac5c or U; wherein "U" is a natural or unnatural amino acid comprising a functional group used for covalent attachment to the surfactant X
  MOD_RES (25)..(25): Absent or Gln, Ala, Glu, Cit or U; wherein "U" is a natural or unnatural amino acid comprising a functional group used for covalent attachment to the surfactant X
  MOD_RES (26)..(26): Absent or Trp, Nal2 or U; wherein "U" is a natural or unnatural amino acid comprising a functional group used for covalent attachment to the surfactant X
  MOD_RES (27)..(27): Absent or Leu or U; wherein "U" is a natural or unnatural amino acid comprising a functional group used for covalent attachment to the surfactant X
  MOD_RES (28)..(28): Absent or Met, Val, Nle, Lys or U; wherein "U" is a natural or unnatural amino acid comprising a functional group used for covalent attachment to the surfactant X
  MOD_RES (29)..(29): Absent or Asn, Lys or U; wherein "U" is a natural or unnatural amino acid comprising a functional group used for covalent attachment to the surfactant X
  MOD_RES (30)..(30): Absent or Thr, Gly, Aib, Ac4c, Ac5c or U; wherein "U" is a natural or unnatural amino acid comprising a functional group used for covalent attachment to the surfactant X
  MOD_RES (31)..(31): Absent or Lys, Aib, Ac4c, Ac5c or U; wherein "U" is a natural or unnatural amino acid comprising a functional group used for covalent attachment to the surfactant X
  MOD_RES (32)..(32): Absent or Arg, Aib, Ac4c, Ac5c or U; wherein "U" is a natural or unnatural amino acid comprising a functional group used for covalent attachment to the surfactant X
  MOD_RES (33)..(33): Absent or Asn, Aib, Ac4c, Ac5c or U; wherein "U" is a natural or unnatural amino acid comprising a functional group used for covalent attachment to the surfactant X
  MOD_RES (34)..(34): Absent or Arg, Aib, Ac4c, Ac5c or U; wherein "U" is a natural or unnatural amino acid comprising a functional group used for covalent attachment to the surfactant X
  MOD_RES (35)..(35): Absent or Asn, Aib, Ac4c, Ac5c or U; wherein "U" is a natural or unnatural amino acid comprising a functional group used for covalent attachment to the surfactant X
  MOD_RES (36)..(36): Absent or Asn, Aib, Ac4c, Ac5c or U; wherein "U" is a natural or unnatural amino acid comprising a functional group used for covalent attachment to the surfactant X
  MOD_RES (37)..(37): Absent or Ile, Ala, Aib, Ac4c, Ac5C or U; wherein "U" is a natural or unnatural amino acid comprising a functional group used for covalent attachment to the surfactant X
  MOD_RES (38)..(38): Absent or U; wherein "U" is a natural or unnatural amino acid comprising a functional group used for covalent attachment to the surfactant X
  C-term OH, -NH-R3, wherein R3 is H or C1-C12 substituted or unsubstituted alkyl or a PEG chain of less than 10Da
  see specification as filed for detailed description of substitutions and preferred embodiments
XXXXXXXXXXXXXXXXXXXXXXXXXXXXXXXXXXXXXX

SEQ ID NO: 304 - protein, 30 aa, Artificial Sequence
  Description of Artificial Sequence: Synthetic peptide
  MOD_RES (1)..(1): pGlu or absent
  MOD_RES (2)..(2): His, N-Ac-His or N-R3-His
  MOD_RES (3)..(3): Ser, Ala, Gly, Aib, Ac4c or Ac5c
  MOD_RES (4)..(4): Gln or Cit
  MOD_RES (5)..(5): Gly or D-Ala
  MOD_RES (6)..(6): Thr or Ser
  MOD_RES (7)..(7): Phe, Trp, F2Phe, Me2Phe or Nal2
  MOD_RES (8)..(8): Thr or Ser
  MOD_RES (9)..(9): Ser or Asp
  MOD_RES (10)..(10): Asp or Glu
  MOD_RES (11)..(11): Tyr, Leu, Met, Nal2, Bip or Bip2EtMeO
  MOD_RES (12)..(12): Ser, Asn or U; wherein "U" is a natural or unnatural amino acid comprising a functional group used for covalent attachment to the surfactant X
  MOD_RES (13)..(13): Lys, Glu, Ser, Arg or U(X); wherein "U(X)" is a natural or unnatural amino acid comprising a functional group covalently attached to the surfactant X
  MOD_RES (14)..(14): Absent or Tyr, Gln, Cit or U(X); wherein "U(X)" is a natural or unnatural amino acid comprising a functional group covalently attached to the surfactant X
  MOD_RES (15)..(15): Absent or Leu, Met, Nle or U(X); wherein "U(X)" is a natural or unnatural amino acid comprising a functional group covalently attached to the surfactant X
  MOD_RES (16)..(16): Absent or Asp, Glu or U(X); wherein "U(X)" is a natural or unnatural amino acid comprising a functional group covalently attached to the surfactant X
  MOD_RES (17)..(17): Absent or Ser, Gly, Glu, Aib, Ac5c, Lys, Arg or U(X); wherein "U(X)" is a natural or unnatural amino acid comprising a functional group covalently attached to the surfactant X
  MOD_RES (18)..(18): Absent or Arg, hArg, Gln, Glu, Cit, Aib, Ac4c, Ac5c or U(X); wherein "U(X)" is a natural or unnatural amino acid comprising a functional group covalently attached to the surfactant X
  MOD_RES (19)..(19): Absent or Arg, hArg, Ala, Aib, Ac4c, Ac5c or U(X); wherein "U(X)" is a natural or unnatural amino acid comprising a functional group covalently attached to the surfactant X
  MOD_RES (20)..(20): Absent or Ala, Val, Aib, Ac4c, Ac5c or U(X); wherein "U(X)" is a natural or unnatural amino acid comprising a functional group covalently attached to the surfactant X
  MOD_RES (21)..(21): Absent or Gln, Lys, Arg, Cit, Glu, Aib, Ac4c, Ac5c or U(X); wherein "U(X)" is a natural or unnatural amino acid comprising a functional group covalently attached to the surfactant X
  MOD_RES (22)..(22): Absent or Asp, Glu, Leu, Aib, Ac4c, Ac5c or U(X); wherein "U(X)" is a natural or unnatural amino acid comprising a functional group covalently attached to the surfactant X
  MOD_RES (23)..(23): Absent or Phe, Trp, Nal2, Aib, Ac4c, Ac5c or U(X); wherein "U(X)" is a natural or unnatural amino acid comprising a functional group covalently attached to the surfactant X
  MOD_RES (24)..(24): Absent or Val, Ile, Aib, Ac4c, Ac5c or U(X); wherein "U(X)" is a natural or unnatural amino acid comprising a functional group covalently attached to the surfactant X
  MOD_RES (25)..(25): Absent or Gln, Ala, Glu, Cit or U(X); wherein "U(X)" is a natural or unnatural amino acid comprising a functional group covalently attached to the surfactant X
  MOD_RES (26)..(26): Absent or Trp, Nal2 or U(X); wherein "U(X)" is a natural or unnatural amino acid comprising a functional group covalently attached to the surfactant X
  MOD_RES (27)..(27): Absent or Leu or U(X); wherein "U(X)" is a natural or unnatural amino acid comprising a functional group covalently attached to the surfactant X
  MOD_RES (28)..(28): Absent or Met, Val, Nle, Lys or U(X); wherein "U(X)" is a natural or unnatural amino acid comprising a functional group covalently attached to the surfactant X
  MOD_RES (29)..(29): Absent or Asn, Lys or U(X); wherein "U(X)" is a natural or unnatural amino acid comprising a functional group covalently attached to the surfactant X
  MOD_RES (30)..(30): Absent or Thr, Gly, Aib, Ac4c, Ac5c or "U(X)" is a natural or unnatural amino acid comprising a functional group covalently attached to the surfactant X
  C-term OH, or -NH-R3, wherein R3 is H, or C1-C12 substituted or unsubstituted alkyl, or a PEG chain of less than 10 Da
  see specification as filed for detailed description of substitutions and preferred embodiments
XXXXXXXXXXXXXXXXXXXXXXXXXXXXXX

SEQ ID NO: 305 - protein, 23 aa, Artificial Sequence
  Description of Artificial Sequence: Synthetic peptide
  MOD_RES (2)..(2): Ser, Ala, Gly, Aib, Ac4c or Ac5c
  MOD_RES (3)..(3): Gln or Cit
  MOD_RES (6)..(6): Phe, Trp, F2Phe, Me2Phe, MePhe or Nal2
  MOD_RES (10)..(10): Tyr, Leu, Met, Nal2, Bip or Bip2EtMeO
  MOD_RES (11)..(11): Ser, Asn or U(X); wherein "U(X)" is a natural or unnatural amino acid comprising a functional group covalently attached to the surfactant X
  MOD_RES (12)..(12): Lys, Glu, Ser or U(X); wherein "U(X)" is a natural or unnatural amino acid comprising a functional group covalently attached to the surfactant X
  MOD_RES (13)..(13): Absent or Tyr, Gln, Cit or U(X); wherein "U(X)" is a natural or unnatural amino acid comprising a functional group covalently attached to the surfactant X
  MOD_RES (14)..(14): Absent or Leu, Met, Nle or U(X); wherein "U(X)" is a natural or unnatural amino acid comprising a functional group covalently attached to the surfactant X
  MOD_RES (15)..(15): Absent or Asp, Glu or U(X); wherein "U(X)" is a natural or unnatural amino acid comprising a functional group covalently attached to the surfactant X
  MOD_RES (16)..(16): Absent or Ser, Gly, Glu, Aib, Ac5c, Lys, Arg or U(X); wherein "U(X)" is a natural or unnatural amino acid comprising a functional group covalently attached to the surfactant X
  MOD_RES (17)..(17): Absent or Arg, hArg, Gln, Glu, Cit, Aib, Ac4c, Ac5c or U(X); wherein "U(X)" is a natural or unnatural amino acid comprising a functional group covalently attached to the surfactant X
  MOD_RES (18)..(18): Absent or Arg, hArg, Ala, Aib, Ac4c, Ac5c or U(X); wherein "U(X)" is a natural or unnatural amino acid comprising a functional group covalently attached to the surfactant X
  MOD_RES (19)..(19): Absent or Ala, Val, Aib, Ac4c, Ac5c or U(X); wherein "U(X)" is a natural or unnatural amino acid comprising a functional group covalently attached to the surfactant X
  MOD_RES (20)..(20): Absent or Gln, Lys, Arg, Cit, Glu, Aib, Ac4c, Ac5c or U(X); wherein "U(X)" is a natural or unnatural amino acid comprising a functional group covalently attached to the surfactant X
  MOD_RES (21)..(21): Absent or Asp, Glu, Leu, Aib, Ac4c, Ac5c or U(X); wherein "U(X)" is a natural or unnatural amino acid comprising a functional group covalently attached to the surfactant X
  MOD_RES (22)..(22): Absent or Phe, Aib, Ac4c, Ac5c or U(X); wherein "U(X)" is a natural or unnatural amino acid comprising a functional group covalently attached to the surfactant X
  MOD_RES (23)..(23): Absent or Val, Ile, Aib, Ac4c, Ac5c or U(X); wherein "U(X)" is a natural or unnatural amino acid comprising a functional group covalently attached to the surfactant X
  C-term OH, or -NH-R3, wherein R3 is H or substituted or unsubstituted C1-C12 alkyl; or a PEG chain of less than 10Da
  see specification as filed for detailed description of substitutions and preferred embodiments
HXXGTXTSDXXXXXXXXXXXXXX

SEQ ID NO: 306 - protein, 11 aa, Artificial Sequence
  Description of Artificial Sequence: Synthetic peptide
  MOD_RES (2)..(2): Aib
  MOD_RES (11)..(11): Lys(C8)
  C-term amide
HXQGTFTSDLK

SEQ ID NO: 307 - protein, 11 aa, Artificial Sequence
  Description of Artificial Sequence: Synthetic peptide
  MOD_RES (2)..(2): Aib
  MOD_RES (11)..(11): Lys(C12)
  C-term amide
HXQGTFTSDLK

SEQ ID NO: 308 - protein, 11 aa, Artificial Sequence
  Description of Artificial Sequence: Synthetic peptide
  MOD_RES (2)..(2): Aib
  MOD_RES (11)..(11): Lys(C16)
  C-term amide
HXQGTFTSDLK

SEQ ID NO: 309 - protein, 11 aa, Artificial Sequence
  Description of Artificial Sequence: Synthetic peptide
  MOD_RES (2)..(2): Aib
  MOD_RES (10)..(10): Bip
  MOD_RES (11)..(11): Lys(C8)
  C-term amide
HXQGTFTSDXK

SEQ ID NO: 310 - protein, 11 aa, Artificial Sequence
  Description of Artificial Sequence: Synthetic peptide
  MOD_RES (2)..(2): Aib
  MOD_RES (10)..(10): Bip
  MOD_RES (11)..(11): Lys(C12)
  C-term amide
HXQGTFTSDXK

SEQ ID NO: 311 - protein, 11 aa, Artificial Sequence
  Description of Artificial Sequence: Synthetic peptide
  MOD_RES (2)..(2): Aib
  MOD_RES (10)..(10): Bip
  MOD_RES (11)..(11): Lys(C16)
  C-term amide
HXQGTFTSDXK

SEQ ID NO: 312 - protein, 11 aa, Artificial Sequence
  Description of Artificial Sequence: Synthetic peptide
  MOD_RES (2)..(2): Aib
  MOD_RES (10)..(10): Nal(2)
  MOD_RES (11)..(11): Lys(C8)
  C-term amide
HXQGTFTSDAK

SEQ ID NO: 313 - protein, 11 aa, Artificial Sequence
  Description of Artificial Sequence: Synthetic peptide
  MOD_RES (2)..(2): Aib
  MOD_RES (10)..(10): Nal(2)
  MOD_RES (11)..(11): Lys(C12)
  C-term amide
HXQGTFTSDAK

SEQ ID NO: 314 - protein, 11 aa, Artificial Sequence
  Description of Artificial Sequence: Synthetic peptide
  MOD_RES (2)..(2): Aib
  MOD_RES (10)..(10): Nal(2)
  MOD_RES (11)..(11): Lys(C16)
  C-term amide
HXQGTFTSDAK

SEQ ID NO: 315 - protein, 11 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (11)..(11): Lys(C8)
  C-term amide
HXQGTFTSDXK

SEQ ID NO: 316 - protein, 11 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (11)..(11): Lys(C12)
  C-term amide
HXQGTFTSDXK

SEQ ID NO: 317 - protein, 11 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (11)..(11): Lys(C16)
  C-term amide
HXQGTFTSDXK

SEQ ID NO: 318 - protein, 15 aa, Artificial Sequence
  Description of Artificial Sequence: Synthetic peptide
  MOD_RES (2)..(2): Aib
  MOD_RES (15)..(15): Lys(C8)
  C-term amide
HXQGTFTSDLSKYLK

SEQ ID NO: 319 - protein, 15 aa, Artificial Sequence
  Description of Artificial Sequence: Synthetic peptide
  MOD_RES (2)..(2): Aib
  MOD_RES (15)..(15): Lys(C12)
  C-term amide
HXQGTFTSDLSKYLK

SEQ ID NO: 320 - protein, 15 aa, Artificial Sequence
  Description of Artificial Sequence: Synthetic peptide
  MOD_RES (2)..(2): Aib
  MOD_RES (15)..(15): Lys(C16)
  C-term amide
HXQGTFTSDLSKYLK

SEQ ID NO: 321 - protein, 15 aa, Artificial Sequence
  Description of Artificial Sequence: Synthetic peptide
  MOD_RES (2)..(2): Aib
  MOD_RES (10)..(10): Bip
  MOD_RES (15)..(15): Lys(C8)
  C-term amide
HXQGTFTSDXSKYLK

SEQ ID NO: 322 - protein, 15 aa, Artificial Sequence
  Description of Artificial Sequence: Synthetic peptide
  MOD_RES (2)..(2): Aib
  MOD_RES (10)..(10): Bip
  MOD_RES (15)..(15): Lys(C12)
  C-term amide
HXQGTFTSDXSKYLK

SEQ ID NO: 323 - protein, 15 aa, Artificial Sequence
  Description of Artificial Sequence: Synthetic peptide
  MOD_RES (2)..(2): Aib
  MOD_RES (10)..(10): Bip
  MOD_RES (15)..(15): Lys(C16)
  C-term amide
HXQGTFTSDXSKYLK

SEQ ID NO: 324 - protein, 15 aa, Artificial Sequence
  Description of Artificial Sequence: Synthetic peptide
  MOD_RES (2)..(2): Aib
  MOD_RES (10)..(10): Nal(2)
  MOD_RES (15)..(15): Lys(C8)
  C-term amide
HXQGTFTSDASKYLK

SEQ ID NO: 325 - protein, 15 aa, Artificial Sequence
  Description of Artificial Sequence: Synthetic peptide
  MOD_RES (2)..(2): Aib
  MOD_RES (10)..(10): Nal(2)
  MOD_RES (15)..(15): Lys(C12)
  C-term amide
HXQGTFTSDASKYLK

SEQ ID NO: 326 - protein, 15 aa, Artificial Sequence
  Description of Artificial Sequence: Synthetic peptide
  MOD_RES (2)..(2): Aib
  MOD_RES (10)..(10): Nal(2)
  MOD_RES (15)..(15): Lys(C16)
  C-term amide
HXQGTFTSDASKYLK

SEQ ID NO: 327 - protein, 15 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (15)..(15): Lys(C8)
  C-term amide
HXQGTFTSDXSKYLK

SEQ ID NO: 328 - protein, 15 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (15)..(15): Lys(C12)
  C-term amide
HXQGTFTSDXSKYLK

SEQ ID NO: 329 - protein, 15 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (15)..(15): Lys(C16)
  C-term amide
HXQGTFTSDXSKYLK

SEQ ID NO: 330 - protein, 18 aa, Artificial Sequence
  Description of Artificial Sequence: Synthetic peptide
  MOD_RES (2)..(2): Aib
  MOD_RES (18)..(18): Lys(C8)
  C-term amide
HXQGTFTSDVSKYLDGRK

SEQ ID NO: 331 - protein, 18 aa, Artificial Sequence
  Description of Artificial Sequence: Synthetic peptide
  MOD_RES (2)..(2): Aib
  MOD_RES (18)..(18): Lys(C8)
  C-term amide
HXQGTFTSDLSKYLDGRK

SEQ ID NO: 332 - protein, 18 aa, Artificial Sequence
  Description of Artificial Sequence: Synthetic peptide
  MOD_RES (2)..(2): Aib
  MOD_RES (18)..(18): Lys(C12)
  C-term amide
HXQGTFTSDLSKYLDGRK

SEQ ID NO: 333 - protein, 18 aa, Artificial Sequence
  Description of Artificial Sequence: Synthetic peptide
  MOD_RES (2)..(2): Aib
  MOD_RES (18)..(18): Lys(C16)
  C-term amide
HXQGTFTSDLSKYLDGRK

SEQ ID NO: 334 - protein, 18 aa, Artificial Sequence
  Description of Artificial Sequence: Synthetic peptide
  MOD_RES (2)..(2): Aib
  MOD_RES (10)..(10): Bip
  MOD_RES (18)..(18): Lys(C8)
  C-term amide
HXQGTFTSDXSKYLDGRK

SEQ ID NO: 335 - protein, 18 aa, Artificial Sequence
  Description of Artificial Sequence: Synthetic peptide
  MOD_RES (2)..(2): Aib
  MOD_RES (10)..(10): Bip
  MOD_RES (18)..(18): Lys(C12)
  C-term amide
HXQGTFTSDXSKYLDGRK

SEQ ID NO: 336 - protein, 18 aa, Artificial Sequence
  Description of Artificial Sequence: Synthetic peptide
  MOD_RES (2)..(2): Aib
  MOD_RES (10)..(10): Bip
  MOD_RES (18)..(18): Lys(C16)
  C-term amide
HXQGTFTSDXSKYLDGRK

SEQ ID NO: 337 - protein, 18 aa, Artificial Sequence
  Description of Artificial Sequence: Synthetic peptide
  MOD_RES (2)..(2): Aib
  MOD_RES (10)..(10): Nal(2)
  MOD_RES (18)..(18): Lys(C8)
  C-term amide
HXQGTFTSDASKYLDGRK

SEQ ID NO: 338 - protein, 18 aa, Artificial Sequence
  Description of Artificial Sequence: Synthetic peptide
  MOD_RES (2)..(2): Aib
  MOD_RES (10)..(10): Nal(2)
  MOD_RES (18)..(18): Lys(C12)
  C-term amide
HXQGTFTSDASKYLDGRK

SEQ ID NO: 339 - protein, 18 aa, Artificial Sequence
  Description of Artificial Sequence: Synthetic peptide
  MOD_RES (2)..(2): Aib
  MOD_RES (10)..(10): Nal(2)
  MOD_RES (18)..(18): Lys(C16)
  C-term amide
HXQGTFTSDASKYLDGRK

SEQ ID NO: 340 - protein, 18 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (18)..(18): Lys(C8)
  C-term amide
HXQGTFTSDXSKYLDGRK

SEQ ID NO: 341 - protein, 18 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (18)..(18): Lys(C12)
  C-term amide
HXQGTFTSDXSKYLDGRK

SEQ ID NO: 342 - protein, 18 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (18)..(18): Lys(C16)
  C-term amide
HXQGTFTSDXSKYLDGRK

SEQ ID NO: 343 - protein, 11 aa, Artificial Sequence
  Description of Artificial Sequence: Synthetic peptide
  MOD_RES (2)..(2): Aib
  MOD_RES (11)..(11): Lys(C8)
  C-term amide
HXQGTFTSDLK

SEQ ID NO: 344 - protein, 11 aa, Artificial Sequence
  Description of Artificial Sequence: Synthetic peptide
  MOD_RES (2)..(2): Aib
  MOD_RES (11)..(11): Lys(C12)
  C-term amide
HXQGTFTSDLK

SEQ ID NO: 345 - protein, 11 aa, Artificial Sequence
  Description of Artificial Sequence: Synthetic peptide
  MOD_RES (2)..(2): Aib
  MOD_RES (11)..(11): Lys(C16)
  C-term amide
HXQGTFTSDLK

SEQ ID NO: 346 - protein, 11 aa, Artificial Sequence
  Description of Artificial Sequence: Synthetic peptide
  MOD_RES (2)..(2): Aib
  MOD_RES (10)..(10): Bip
  MOD_RES (11)..(11): Lys(C8)
  C-term amide
HXQGTFTSDXK

SEQ ID NO: 347 - protein, 11 aa, Artificial Sequence
  Description of Artificial Sequence: Synthetic peptide
  MOD_RES (2)..(2): Aib
  MOD_RES (10)..(10): Bip
  MOD_RES (11)..(11): Lys(C12)
  C-term amide
HXQGTFTSDXK

SEQ ID NO: 348 - protein, 11 aa, Artificial Sequence
  Description of Artificial Sequence: Synthetic peptide
  MOD_RES (2)..(2): Aib
  MOD_RES (10)..(10): Bip
  MOD_RES (11)..(11): Lys(C16)
  C-term amide
HXQGTFTSDXK

SEQ ID NO: 349 - protein, 11 aa, Artificial Sequence
  Description of Artificial Sequence: Synthetic peptide
  MOD_RES (2)..(2): Aib
  MOD_RES (10)..(10): Nal(2)
  MOD_RES (11)..(11): Lys(C8)
  C-term amide
HXQGTFTSDAK

SEQ ID NO: 350 - protein, 11 aa, Artificial Sequence
  Description of Artificial Sequence: Synthetic peptide
  MOD_RES (2)..(2): Aib
  MOD_RES (10)..(10): Nal(2)
  MOD_RES (11)..(11): Lys(C12)
  C-term amide
HXQGTFTSDAK

SEQ ID NO: 351 - protein, 11 aa, Artificial Sequence
  Description of Artificial Sequence: Synthetic peptide
  MOD_RES (2)..(2): Aib
  MOD_RES (10)..(10): Nal(2)
  MOD_RES (11)..(11): Lys(C16)
  C-term amide
HXQGTFTSDAK

SEQ ID NO: 352 - protein, 11 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (11)..(11): Lys(C8)
  C-term amide
HXQGTFTSDXK

SEQ ID NO: 353 - protein, 11 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (11)..(11): Lys(C12)
  C-term amide
HXQGTFTSDXK

SEQ ID NO: 354 - protein, 11 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (11)..(11): Lys(C16)
  C-term amide
HXQGTFTSDXK

SEQ ID NO: 355 - protein, 11 aa, Artificial Sequence
  Description of Artificial Sequence: Synthetic peptide
  MOD_RES (2)..(2): Aib
  MOD_RES (6)..(6): 2,6Me-Phe
  MOD_RES (10)..(10): Bip
  MOD_RES (11)..(11): Lys(C8)
  C-term amide
HXQGTFTSDXK

SEQ ID NO: 356 - protein, 11 aa, Artificial Sequence
  Description of Artificial Sequence: Synthetic peptide
  MOD_RES (2)..(2): Aib
  MOD_RES (6)..(6): 2,6Me-Phe
  MOD_RES (10)..(10): Bip
  MOD_RES (11)..(11): Lys(C12)
  C-term amide
HXQGTFTSDXK

SEQ ID NO: 357 - protein, 11 aa, Artificial Sequence
  Description of Artificial Sequence: Synthetic peptide
  MOD_RES (2)..(2): Aib
  MOD_RES (6)..(6): 2,6Me-Phe
  MOD_RES (10)..(10): Bip
  MOD_RES (11)..(11): Lys(C16)
  C-term amide
HXQGTFTSDXK

SEQ ID NO: 358 - protein, 15 aa, Artificial Sequence
  Description of Artificial Sequence: Synthetic peptide
  MOD_RES (2)..(2): Aib
  MOD_RES (6)..(6): Me-Phe
  MOD_RES (15)..(15): Lys(C8)
  C-term amide
HXQGTFTSDLSKYLK

SEQ ID NO: 359 - protein, 15 aa, Artificial Sequence
  Description of Artificial Sequence: Synthetic peptide
  MOD_RES (2)..(2): Aib
  MOD_RES (6)..(6): Me-Phe
  MOD_RES (15)..(15): Lys(C12)
  C-term amide
HXQGTFTSDLSKYLK

SEQ ID NO: 360 - protein, 15 aa, Artificial Sequence
  Description of Artificial Sequence: Synthetic peptide
  MOD_RES (2)..(2): Aib
  MOD_RES (6)..(6): Me-Phe
  MOD_RES (15)..(15): Lys(C16)
  C-term amide
HXQGTFTSDLSKYLK

SEQ ID NO: 361 - protein, 15 aa, Artificial Sequence
  Description of Artificial Sequence: Synthetic peptide
  MOD_RES (2)..(2): Aib
  MOD_RES (6)..(6): Me-Phe
  MOD_RES (10)..(10): Bip
  MOD_RES (15)..(15): Lys(C8)
  C-term amide
HXQGTFTSDXSKYLK

SEQ ID NO: 362 - protein, 15 aa, Artificial Sequence
  Description of Artificial Sequence: Synthetic peptide
  MOD_RES (2)..(2): Aib
  MOD_RES (6)..(6): Me-Phe
  MOD_RES (10)..(10): Bip
  MOD_RES (15)..(15): Lys(C12)
  C-term amide
HXQGTFTSDXSKYLK

SEQ ID NO: 363 - protein, 15 aa, Artificial Sequence
  Description of Artificial Sequence: Synthetic peptide
  MOD_RES (2)..(2): Aib
  MOD_RES (6)..(6): Me-Phe
  MOD_RES (10)..(10): Bip
  MOD_RES (15)..(15): Lys(C16)
  C-term amide
HXQGTFTSDXSKYLK

SEQ ID NO: 364 - protein, 15 aa, Artificial Sequence
  Description of Artificial Sequence: Synthetic peptide
  MOD_RES (2)..(2): Aib
  MOD_RES (6)..(6): Me-Phe
  MOD_RES (10)..(10): Nal(2)
  MOD_RES (15)..(15): Lys(C8)
  C-term amide
HXQGTFTSDASKYLK

SEQ ID NO: 365 - protein, 15 aa, Artificial Sequence
  Description of Artificial Sequence: Synthetic peptide
  MOD_RES (2)..(2): Aib
  MOD_RES (6)..(6): Me-Phe
  MOD_RES (10)..(10): Nal(2)
  MOD_RES (15)..(15): Lys(C12)
  C-term amide
HXQGTFTSDASKYLK

SEQ ID NO: 366 - protein, 15 aa, Artificial Sequence
  Description of Artificial Sequence: Synthetic peptide
  MOD_RES (2)..(2): Aib
  MOD_RES (6)..(6): Me-Phe
  MOD_RES (10)..(10): Nal(2)
  MOD_RES (15)..(15): Lys(C16)
  C-term amide
HXQGTFTSDASKYLK

SEQ ID NO: 367 - protein, 15 aa, Artificial Sequence
  Description of Artificial Sequence: Synthetic peptide
  MOD_RES (2)..(2): Aib
  MOD_RES (6)..(6): Me-Phe
  MOD_RES (10)..(10): Bip2Et4MeO
  MOD_RES (15)..(15): Lys(C8)
  C-term amide
HXQGTFTSDXSKYLK

SEQ ID NO: 368 - protein, 15 aa, Artificial Sequence
  Description of Artificial Sequence: Synthetic peptide
  MOD_RES (2)..(2): Aib
  MOD_RES (6)..(6): Me-Phe
  MOD_RES (10)..(10): Bip2Et4MeO
  MOD_RES (15)..(15): Lys(C12)
  C-term amide
HXQGTFTSDXSKYLK

SEQ ID NO: 369 - protein, 15 aa, Artificial Sequence
  Description of Artificial Sequence: Synthetic peptide
  MOD_RES (2)..(2): Aib
  MOD_RES (6)..(6): Me-Phe
  MOD_RES (10)..(10): Bip2Et4MeO
  MOD_RES (15)..(15): Lys(C16)
  C-term amide
HXQGTFTSDXSKYLK

SEQ ID NO: 370 - protein, 17 aa, Artificial Sequence
  Description of Artificial Sequence: Synthetic peptide
  MOD_RES (2)..(2): Aib
  MOD_RES (17)..(17): Lys(C8)
  C-term amide
HXQGTFTSDVSKYLESK

SEQ ID NO: 371 - protein, 17 aa, Artificial Sequence
  Description of Artificial Sequence: Synthetic peptide
  MOD_RES (2)..(2): Aib
  MOD_RES (17)..(17): Lys(C8)
  C-term amide
HXQGTFTSDLSKYLESK

SEQ ID NO: 372 - protein, 17 aa, Artificial Sequence
  Description of Artificial Sequence: Synthetic peptide
  MOD_RES (2)..(2): Aib
  MOD_RES (17)..(17): Lys(C12)
  C-term amide
HXQGTFTSDLSKYLESK

SEQ ID NO: 373 - protein, 17 aa, Artificial Sequence
  Description of Artificial Sequence: Synthetic peptide
  MOD_RES (2)..(2): Aib
  MOD_RES (17)..(17): Lys(C16)
  C-term amide
HXQGTFTSDLSKYLESK

SEQ ID NO: 374 - protein, 17 aa, Artificial Sequence
  Description of Artificial Sequence: Synthetic peptide
  MOD_RES (2)..(2): Aib
  MOD_RES (10)..(10): Bip
  MOD_RES (17)..(17): Lys(C8)
  C-term amide
HXQGTFTSDXSKYLESK

SEQ ID NO: 375 - protein, 17 aa, Artificial Sequence
  Description of Artificial Sequence: Synthetic peptide
  MOD_RES (2)..(2): Aib
  MOD_RES (10)..(10): Bip
  MOD_RES (17)..(17): Lys(C12)
  C-term amide
HXQGTFTSDXSKYLESK

SEQ ID NO: 376 - protein, 17 aa, Artificial Sequence
  Description of Artificial Sequence: Synthetic peptide
  MOD_RES (2)..(2): Aib
  MOD_RES (10)..(10): Bip
  MOD_RES (17)..(17): Lys(C16)
  C-term amide
HXQGTFTSDXSKYLESK

SEQ ID NO: 377 - protein, 17 aa, Artificial Sequence
  Description of Artificial Sequence: Synthetic peptide
  MOD_RES (2)..(2): Aib
  MOD_RES (10)..(10): Nal(2)
  MOD_RES (17)..(17): Lys(C8)
  C-term amide
HXQGTFTSDASKYLESK

SEQ ID NO: 378 - protein, 17 aa, Artificial Sequence
  Description of Artificial Sequence: Synthetic peptide
  MOD_RES (2)..(2): Aib
  MOD_RES (10)..(10): Nal(2)
  MOD_RES (17)..(17): Lys(C12)
  C-term amide
HXQGTFTSDASKYLESK

SEQ ID NO: 379 - protein, 17 aa, Artificial Sequence
  Description of Artificial Sequence: Synthetic peptide
  MOD_RES (2)..(2): Aib
  MOD_RES (10)..(10): Nal(2)
  MOD_RES (17)..(17): Lys(C16)
  C-term amide
HXQGTFTSDASKYLESK

SEQ ID NO: 380 - protein, 17 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (17)..(17): Lys(C8)
  C-term amide
HXQGTFTSDXSKYLESK

SEQ ID NO: 381 - protein, 17 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (17)..(17): Lys(C12)
  C-term amide
HXQGTFTSDXSKYLESK

SEQ ID NO: 382 - protein, 17 aa, Artificial Sequence
  Description of Artificial Sequence: Synthetic peptide
  MOD_RES (2)..(2): Aib
  MOD_RES (6)..(6): 2,6F-Phe
  MOD_RES (10)..(10): Bip2Et4MeO
  MOD_RES (17)..(17): Lys(C16)
  C-term amide
HXQGTFTSDXSKYLESK

SEQ ID NO: 383 - protein, 17 aa, Artificial Sequence
  Description of Artificial Sequence: Synthetic peptide
  MOD_RES (2)..(2): Aib
  MOD_RES (10)..(10): Bip
  MOD_RES (17)..(17): Lys(C8)
  C-term amide
HXQGTFTSDXSKYLDSK

SEQ ID NO: 384 - protein, 17 aa, Artificial Sequence
  Description of Artificial Sequence: Synthetic peptide
  MOD_RES (2)..(2): Aib
  MOD_RES (10)..(10): Bip
  MOD_RES (17)..(17): Lys(C12)
  C-term amide
HXQGTFTSDXSKYLDSK

SEQ ID NO: 385 - protein, 17 aa, Artificial Sequence
  Description of Artificial Sequence: Synthetic peptide
  MOD_RES (2)..(2): Aib
  MOD_RES (10)..(10): Bip
  MOD_RES (17)..(17): Lys(C16)
  C-term amide
HXQGTFTSDXSKYLDSK

SEQ ID NO: 386 - protein, 17 aa, Artificial Sequence
  Description of Artificial Sequence: Synthetic peptide
  MOD_RES (2)..(2): Aib
  MOD_RES (10)..(10): Bip
  MOD_RES (17)..(17): Lys(C8)
  C-term amide
HXQGTFTSDXSKYLDRK

SEQ ID NO: 387 - protein, 17 aa, Artificial Sequence
  Description of Artificial Sequence: Synthetic peptide
  MOD_RES (2)..(2): Aib
  MOD_RES (10)..(10): Bip
  MOD_RES (17)..(17): Lys(C12)
  C-term amide
HXQGTFTSDXSKYLDRK

SEQ ID NO: 388 - protein, 17 aa, Artificial Sequence
  Description of Artificial Sequence: Synthetic peptide
  MOD_RES (2)..(2): Aib
  MOD_RES (10)..(10): Bip
  MOD_RES (17)..(17): Lys(C16)
  C-term amide
HXQGTFTSDXSKYLDRK

SEQ ID NO: 389 - protein, 17 aa, Artificial Sequence
  Description of Artificial Sequence: Synthetic peptide
  MOD_RES (2)..(2): Aib
  MOD_RES (17)..(17): Lys(C8)
  C-term amide
HXQGTFTSDYSKYLDRK

SEQ ID NO: 390 - protein, 17 aa, Artificial Sequence
  Description of Artificial Sequence: Synthetic peptide
  MOD_RES (2)..(2): Aib
  MOD_RES (17)..(17): Lys(C12)
  C-term amide
HXQGTFTSDYSKYLDRK

SEQ ID NO: 391 - protein, 17 aa, Artificial Sequence
  Description of Artificial Sequence: Synthetic peptide
  MOD_RES (2)..(2): Aib
  MOD_RES (17)..(17): Lys(C16)
  C-term amide
HXQGTFTSDYSKYLDRK

SEQ ID NO: 392 - protein, 17 aa, Artificial Sequence
  Description of Artificial Sequence: Synthetic peptide
  MOD_RES (2)..(2): Aib
  MOD_RES (16)..(16): hArg
  MOD_RES (17)..(17): Lys(C12)
  C-term amide
HXQGTFTSDYSKYLDRK

SEQ ID NO: 393 - protein, 17 aa, Artificial Sequence
  Description of Artificial Sequence: Synthetic peptide
  MOD_RES (2)..(2): Aib
  MOD_RES (10)..(10): Bip
  MOD_RES (17)..(17): Lys(C12)
  C-term amide
HXQGTFTSDXSKYLESK

SEQ ID NO: 394 - protein, 17 aa, Artificial Sequence
  Description of Artificial Sequence: Synthetic peptide
  MOD_RES (2)..(2): Aib
  MOD_RES (6)..(6): Me-Phe
  MOD_RES (10)..(10): Bip
  MOD_RES (17)..(17): Lys(C12)
  C-term amide
HXQGTFTSDXSKYLESK

SEQ ID NO: 395 - protein, 17 aa, Artificial Sequence
  Description of Artificial Sequence: Synthetic peptide
  MOD_RES (2)..(2): Aib
  MOD_RES (6)..(6): Me-Phe
  MOD_RES (10)..(10): Bip
  MOD_RES (12)..(12): Aib
  MOD_RES (17)..(17): Lys(C12)
  C-term amide
HXQGTFTSDXSXYLESK

SEQ ID NO: 396 - protein, 17 aa, Artificial Sequence
  Description of Artificial Sequence: Synthetic peptide
  MOD_RES (2)..(2): Aib
  MOD_RES (6)..(6): Me-Phe
  MOD_RES (10)..(10): Bip
  MOD_RES (16)..(16): Aib
  MOD_RES (17)..(17): Lys(C12)
  C-term amide
HXQGTFTSDXSKYLEXK

SEQ ID NO: 397 - protein, 17 aa, Artificial Sequence
  Description of Artificial Sequence: Synthetic peptide
  MOD_RES (2)..(2): Aib
  MOD_RES (6)..(6): Me-Phe
  MOD_RES (16)..(16): Aib
  MOD_RES (17)..(17): Lys(C12)
  C-term amide
HXQGTFTSDYSKYLDXK

SEQ ID NO: 398 - protein, 17 aa, Artificial Sequence
  Description of Artificial Sequence: Synthetic peptide
  MOD_RES (2)..(2): Aib
  MOD_RES (6)..(6): Me-Phe
  MOD_RES (11)..(11): Aib
  MOD_RES (16)..(16): Aib
  MOD_RES (17)..(17): Lys(C12)
  C-term amide
HXQGTFTSDYXKYLDXK

SEQ ID NO: 399 - protein, 12 aa, Artificial Sequence
  Description of Artificial Sequence: Synthetic peptide
  MOD_RES (2)..(2): Aib
  MOD_RES (6)..(6): Me-Phe
  MOD_RES (11)..(11): Aib
  MOD_RES (12)..(12): Lys(C12)
  C-term amide
HXQGTFTSDYXK

SEQ ID NO: 400 - protein, 12 aa, Artificial Sequence
  Description of Artificial Sequence: Synthetic peptide
  MOD_RES (2)..(2): Aib
  MOD_RES (6)..(6): Me-Phe
  MOD_RES (10)..(10): Nal(2)
  MOD_RES (11)..(11): Aib
  MOD_RES (12)..(12): Lys(C12)
  C-term amide
HXQGTFTSDAXK

SEQ ID NO: 401 - protein, 18 aa, Artificial Sequence
  Description of Artificial Sequence: Synthetic peptide
  MOD_RES (2)..(2): Aib
  MOD_RES (6)..(6): Me-Phe
  MOD_RES (16)..(16): Aib
  MOD_RES (17)..(17): Lys(C12)
  MOD_RES (18)..(18): Aib
  C-term amide
HXQGTFTSDYSKYLDXKX

SEQ ID NO: 402 - protein, 18 aa, Artificial Sequence
  Description of Artificial Sequence: Synthetic peptide
  MOD_RES (2)..(2): Aib
  MOD_RES (6)..(6): Me-Phe
  MOD_RES (10)..(10): Nal(2)
  MOD_RES (16)..(16): Aib
  MOD_RES (17)..(17): Lys(C12)
  MOD_RES (18)..(18): Aib
  C-term amide
HXQGTFTSDASKYLDXKX

SEQ ID NO: 403 - protein, 17 aa, Artificial Sequence
  Description of Artificial Sequence: Synthetic peptide
  MOD_RES (2)..(2): Aib
  MOD_RES (6)..(6): Me-Phe
  MOD_RES (11)..(11): Aib
  MOD_RES (16)..(16): Aib
  MOD_RES (17)..(17): Lys(C12)
  C-term amide
HXQGTFTSDYXKYLDXK

SEQ ID NO: 404 - protein, 18 aa, Artificial Sequence
  Description of Artificial Sequence: Synthetic peptide
  MOD_RES (2)..(2): Aib
  MOD_RES (6)..(6): Me-Phe
  MOD_RES (11)..(11): Aib
  MOD_RES (16)..(16): Aib
  MOD_RES (17)..(17): Lys(C12)
  MOD_RES (18)..(18): Aib
  C-term amide
HXQGTFTSDYXKYLDXKX

SEQ ID NO: 405 - protein, 18 aa, Artificial Sequence
  Description of Artificial Sequence: Synthetic peptide
  MOD_RES (2)..(2): Aib
  MOD_RES (6)..(6): Me-Phe
  MOD_RES (16)..(16): Aib
  MOD_RES (17)..(17): Lys(C12)
  MOD_RES (18)..(18): Aib
  C-term amide
HXQGTFTSDYSKYLDXKX

SEQ ID NO: 406 - protein, 19 aa, Artificial Sequence
  Description of Artificial Sequence: Synthetic peptide
  MOD_RES (2)..(2): Aib
  MOD_RES (6)..(6): Me-Phe
  MOD_RES (17)..(17): Aib
  MOD_RES (18)..(18): Lys(C12)
  MOD_RES (19)..(19): Aib
  C-term amide
HXQGTFTSDYSKYLDRXKX

SEQ ID NO: 407 - protein, 19 aa, Artificial Sequence
  Description of Artificial Sequence: Synthetic peptide
  MOD_RES (2)..(2): Aib
  MOD_RES (6)..(6): Me-Phe
  MOD_RES (11)..(11): Aib
  MOD_RES (17)..(17): Aib
  MOD_RES (18)..(18): Lys(C12)
  MOD_RES (19)..(19): Aib
  C-term amide
HXQGTFTSDYXKYLDRXKX

SEQ ID NO: 408 - protein, 19 aa, Artificial Sequence
  Description of Artificial Sequence: Synthetic peptide
  MOD_RES (2)..(2): Aib
  MOD_RES (6)..(6): Me-Phe
  MOD_RES (11)..(11): Aib
  MOD_RES (17)..(17): Aib
  MOD_RES (18)..(18): Lys(C12)
  MOD_RES (19)..(19): Ac5c
  C-term amide
HXQGTFTSDYXKYLDRXKX

SEQ ID NO: 409 - protein, 18 aa, Artificial Sequence
  Description of Artificial Sequence: Synthetic peptide
  MOD_RES (2)..(2): Aib
  MOD_RES (6)..(6): Me-Phe
  MOD_RES (10)..(10): Nal(2)
  MOD_RES (11)..(11): Aib
  MOD_RES (17)..(17): Aib
  MOD_RES (18)..(18): Lys(C12)
  C-term amide
HXQGTFTSDAXKYLERXK

SEQ ID NO: 410 - protein, 19 aa, Artificial Sequence
  Description of Artificial Sequence: Synthetic peptide
  MOD_RES (2)..(2): Aib
  MOD_RES (16)..(16): hArg
  MOD_RES (17)..(17): Aib
  MOD_RES (18)..(18): Lys(C8)
  MOD_RES (19)..(19): Aib
  C-term amide
HXQGTFTSDYSKYLDRXKX

SEQ ID NO: 411 - protein, 19 aa, Artificial Sequence
  Description of Artificial Sequence: Synthetic peptide
  MOD_RES (2)..(2): Aib
  MOD_RES (16)..(16): hArg
  MOD_RES (17)..(17): Aib
  MOD_RES (18)..(18): Lys(C12)
  MOD_RES (19)..(19): Aib
  C-term amide
HXQGTFTSDYSKYLDRXKX

SEQ ID NO: 412 - protein, 19 aa, Artificial Sequence
  Description of Artificial Sequence: Synthetic peptide
  MOD_RES (2)..(2): Aib
  MOD_RES (16)..(16): hArg
  MOD_RES (17)..(17): Aib
  MOD_RES (18)..(18): Lys(C16)
  MOD_RES (19)..(19): Aib
  C-term amide
HXQGTFTSDYSKYLDRXKX

SEQ ID NO: 413 - protein, 14 aa, Artificial Sequence
  Description of Artificial Sequence: Synthetic peptide
  MOD_RES (2)..(2): Aib
  MOD_RES (6)..(6): Me-Phe
  MOD_RES (11)..(11): Aib
  MOD_RES (14)..(14): Lys(C12)
  C-term amide
HXQGTFTSDYXKYK

SEQ ID NO: 414 - protein, 14 aa, Artificial Sequence
  Description of Artificial Sequence: Synthetic peptide
  MOD_RES (2)..(2): Aib
  MOD_RES (6)..(6): Me-Phe
  MOD_RES (11)..(11): Aib
  MOD_RES (14)..(14): Lys(C12)
  C-term NHEt
HXQGTFTSDYXKYK

SEQ ID NO: 415 - protein, 15 aa, Artificial Sequence
  Description of Artificial Sequence: Synthetic peptide
  MOD_RES (2)..(2): Aib
  MOD_RES (6)..(6): Me-Phe
  MOD_RES (11)..(11): Aib
  MOD_RES (14)..(14): Lys(C12)
  MOD_RES (15)..(15): Aib
  C-term amide
HXQGTFTSDYXKYKX

SEQ ID NO: 416 - protein, 15 aa, Artificial Sequence
  Description of Artificial Sequence: Synthetic peptide
  MOD_RES (2)..(2): Aib
  MOD_RES (6)..(6): Me-Phe
  MOD_RES (11)..(11): Aib
  MOD_RES (14)..(14): Lys(C12)
  MOD_RES (15)..(15): Aib
  C-term NHEt
HXQGTFTSDYXKYKX

SEQ ID NO: 417 - protein, 15 aa, Artificial Sequence
  Description of Artificial Sequence: Synthetic peptide
  MOD_RES (2)..(2): Aib
  MOD_RES (6)..(6): Me-Phe
  MOD_RES (11)..(11): Aib
  MOD_RES (14)..(14): Lys(C12)
  MOD_RES (15)..(15): Ac5c
  C-term amide
HXQGTFTSDYXKYKX

SEQ ID NO: 418 - protein, 17 aa, Artificial Sequence
  Description of Artificial Sequence: Synthetic peptide
  MOD_RES (2)..(2): Aib
  MOD_RES (6)..(6): Me-Phe
  MOD_RES (16)..(16): Aib
  MOD_RES (17)..(17): Lys(C8)
  C-term amide
HXQGTFTSDYSKYLDXK

SEQ ID NO: 419 - protein, 17 aa, Artificial Sequence
  Description of Artificial Sequence: Synthetic peptide
  MOD_RES (2)..(2): Aib
  MOD_RES (6)..(6): Me-Phe
  MOD_RES (16)..(16): Aib
  MOD_RES (17)..(17): Lys(C16)
  C-term amide
HXQGTFTSDYSKYLDXK

SEQ ID NO: 420 - protein, 17 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C8)
  C-term amide
HXQGTFTSDYSKYLDXK

SEQ ID NO: 421 - protein, 17 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C12)
  C-term amide
HXQGTFTSDYSKYLDXK

SEQ ID NO: 422 - protein, 17 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C16)
  C-term amide
HXQGTFTSDYSKYLDXK

SEQ ID NO: 423 - protein, 19 aa, Artificial Sequence
  Description of Artificial Sequence: Synthetic peptide
  MOD_RES (2)..(2): Aib
  MOD_RES (6)..(6): Me-Phe
  MOD_RES (17)..(17): Aib
  MOD_RES (18)..(18): Lys(C8)
  MOD_RES (19)..(19): Aib
  C-term amide
HXQGTFTSDYSKYLDSXKX

SEQ ID NO: 424 - protein, 19 aa, Artificial Sequence
  Description of Artificial Sequence: Synthetic peptide
  MOD_RES (2)..(2): Aib
  MOD_RES (6)..(6): Me-Phe
  MOD_RES (17)..(17): Aib
  MOD_RES (18)..(18): Lys(C12)
  MOD_RES (19)..(19): Aib
  C-term amide
HXQGTFTSDYSKYLDSXKX

SEQ ID NO: 425 - protein, 19 aa, Artificial Sequence
  Description of Artificial Sequence: Synthetic peptide
  MOD_RES (2)..(2): Aib
  MOD_RES (6)..(6): Me-Phe
  MOD_RES (17)..(17): Aib
  MOD_RES (18)..(18): Lys(C16)
  MOD_RES (19)..(19): Aib
  C-term amide
HXQGTFTSDYSKYLDSXKX

SEQ ID NO: 426 - protein, 19 aa, Artificial Sequence
  Description of Artificial Sequence: Synthetic peptide
  MOD_RES (2)..(2): Aib
  MOD_RES (6)..(6): Me-Phe
  MOD_RES (17)..(17): Aib
  MOD_RES (18)..(18): Lys(C8)
  MOD_RES (19)..(19): Ac5c
  C-term amide
HXQGTFTSDYSKYLDSXKX

SEQ ID NO: 427 - protein, 19 aa, Artificial Sequence
  Description of Artificial Sequence: Synthetic peptide
  MOD_RES (2)..(2): Aib
  MOD_RES (6)..(6): Me-Phe
  MOD_RES (17)..(17): Aib
  MOD_RES (18)..(18): Lys(C12)
  MOD_RES (19)..(19): Ac5c
  C-term amide
HXQGTFTSDYSKYLDSXKX

SEQ ID NO: 428 - protein, 19 aa, Artificial Sequence
  Description of Artificial Sequence: Synthetic peptide
  MOD_RES (2)..(2): Aib
  MOD_RES (6)..(6): Me-Phe
  MOD_RES (17)..(17): Aib
  MOD_RES (18)..(18): Lys(C16)
  MOD_RES (19)..(19): Ac5c
  C-term amide
HXQGTFTSDYSKYLDSXKX

SEQ ID NO: 429 - protein, 19 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C8)
  MOD_RES (19)..(19): Ac5c
  C-term amide
HXQGTFTSDYSKYLDSXKX

SEQ ID NO: 430 - protein, 19 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C12)
  MOD_RES (19)..(19): Ac5c
  C-term amide
HXQGTFTSDYSKYLDSXKX

SEQ ID NO: 431 - protein, 19 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C16)
  MOD_RES (19)..(19): Ac5c
  C-term amide
HXQGTFTSDYSKYLDSXKX

SEQ ID NO: 432 - protein, 20 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (19)..(19): Lys(C8)
  MOD_RES (20)..(20): Aib
  C-term amide
HXQGTFTSDYSKYLDSRXKX

SEQ ID NO: 433 - protein, 20 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (19)..(19): Lys(C12)
  MOD_RES (20)..(20): Aib
  C-term amide
HXQGTFTSDYSKYLDSRXKX

SEQ ID NO: 434 - protein, 20 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (19)..(19): Lys(C16)
  MOD_RES (20)..(20): Aib
  C-term amide
HXQGTFTSDYSKYLDSRXKX

SEQ ID NO: 435 - protein, 20 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (19)..(19): Lys(C8)
  MOD_RES (20)..(20): Ac5c
  C-term amide
HXQGTFTSDYSKYLDSRXKX

SEQ ID NO: 436 - protein, 20 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (19)..(19): Lys(C12)
  MOD_RES (20)..(20): Ac5c
  C-term amide
HXQGTFTSDYSKYLDSRXKX

SEQ ID NO: 437 - protein, 20 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (19)..(19): Lys(C16)
  MOD_RES (20)..(20): Ac5c
  C-term amide
HXQGTFTSDYSKYLDSRXKX

SEQ ID NO: 438 - protein, 20 aa, Artificial Sequence
  Description of Artificial Sequence: Synthetic peptide
  MOD_RES (2)..(2): Aib
  MOD_RES (18)..(18): Aib
  MOD_RES (19)..(19): Lys(C8)
  MOD_RES (20)..(20): Aib
  C-term amide
HXQGTFTSDYSKYLDSRXKX

SEQ ID NO: 439 - protein, 20 aa, Artificial Sequence
  Description of Artificial Sequence: Synthetic peptide
  MOD_RES (2)..(2): Aib
  MOD_RES (18)..(18): Aib
  MOD_RES (19)..(19): Lys(C12)
  MOD_RES (20)..(20): Aib
  C-term amide
HXQGTFTSDYSKYLDSRXKX

SEQ ID NO: 440 - protein, 20 aa, Artificial Sequence
  Description of Artificial Sequence: Synthetic peptide
  MOD_RES (2)..(2): Aib
  MOD_RES (18)..(18): Aib
  MOD_RES (19)..(19): Lys(C16)
  MOD_RES (20)..(20): Aib
  C-term amide
HXQGTFTSDYSKYLDSRXKX

SEQ ID NO: 441 - protein, 23 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (21)..(21): Lys(C8)
  MOD_RES (23)..(23): Aib
  C-term amide
HXQGTFTSDYSKYLDSRXAQKFX

SEQ ID NO: 442 - protein, 23 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (21)..(21): Lys(C12)
  MOD_RES (23)..(23): Aib
  C-term amide
HXQGTFTSDYSKYLDSRXAQKFX

SEQ ID NO: 443 - protein, 23 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (21)..(21): Lys(C16)
  MOD_RES (23)..(23): Aib
  C-term amide
HXQGTFTSDYSKYLDSRXAQKFX

SEQ ID NO: 444 - protein, 23 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (21)..(21): Lys(C8)
  MOD_RES (23)..(23): Aib
  C-term amide
HXQGTFTSDYSKYLDSRXAQKFX

SEQ ID NO: 445 - protein, 23 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (21)..(21): Lys(C12)
  MOD_RES (23)..(23): Aib
  C-term amide
HXQGTFTSDYSKYLDSRXAQKFX

SEQ ID NO: 446 - protein, 23 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (21)..(21): Lys(C16)
  MOD_RES (23)..(23): Aib
  C-term amide
HXQGTFTSDYSKYLDSRXAQKFX

SEQ ID NO: 447 - protein, 23 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (21)..(21): Lys(C8)
  MOD_RES (23)..(23): Ac5c
  C-term amide
HXQGTFTSDYSKYLDSRXAQKFX

SEQ ID NO: 448 - protein, 23 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (21)..(21): Lys(C12)
  MOD_RES (23)..(23): Ac5c
  C-term amide
HXQGTFTSDYSKYLDSRXAQKFX

SEQ ID NO: 449 - protein, 23 aa, Artificial Sequence
  Description of Artificial Sequence: Synthetic peptide
  MOD_RES (2)..(2): Aib
  MOD_RES (6)..(6): Me-Phe
  MOD_RES (18)..(18): Aib
  MOD_RES (21)..(21): Lys(C16)
  MOD_RES (23)..(23): Ac5c
  C-term amide
HXQGTFTSDYSKYLDSRXAQKFX

SEQ ID NO: 450 - protein, 23 aa, Artificial Sequence
  Description of Artificial Sequence: Synthetic peptide
  MOD_RES (2)..(2): Aib
  MOD_RES (6)..(6): Me-Phe
  misc_feature (12)..(16): Cyclic
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Aib
  MOD_RES (21)..(21): Lys(C8)
  MOD_RES (23)..(23): Aib
  C-term amide
HXQGTFTSDYSEYLDKRXAQKFX

SEQ ID NO: 451 - protein, 23 aa, Artificial Sequence
  Description of Artificial Sequence: Synthetic peptide
  MOD_RES (2)..(2): Aib
  MOD_RES (6)..(6): Me-Phe
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Aib
  MOD_RES (21)..(21): Lys(C12)
  MOD_RES (23)..(23): Aib
  C-term amide
HXQGTFTSDYSEYLDKRXAQKFX

SEQ ID NO: 452 - protein, 23 aa, Artificial Sequence
  Description of Artificial Sequence: Synthetic peptide
  MOD_RES (2)..(2): Aib
  MOD_RES (6)..(6): Me-Phe
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Aib
  MOD_RES (21)..(21): Lys(C16)
  MOD_RES (23)..(23): Aib
  C-term amide
HXQGTFTSDYSEYLDKRXAQKFX

SEQ ID NO: 453 - protein, 23 aa, Artificial Sequence
  Description of Artificial Sequence: Synthetic peptide
  MOD_RES (2)..(2): Aib
  MOD_RES (6)..(6): Me-Phe
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Aib
  MOD_RES (21)..(21): Lys(C8)
  MOD_RES (23)..(23): Ac5c
  C-term amide
HXQGTFTSDYSEYLDKRXAQKFX

SEQ ID NO: 454 - protein, 23 aa, Artificial Sequence
  Description of Artificial Sequence: Synthetic peptide
  MOD_RES (2)..(2): Aib
  MOD_RES (6)..(6): Me-Phe
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Aib
  MOD_RES (21)..(21): Lys(C12)
  MOD_RES (23)..(23): Ac5c
  C-term amide
HXQGTFTSDYSEYLDKRXAQKFX

SEQ ID NO: 455 - protein, 23 aa, Artificial Sequence
  Description of Artificial Sequence: Synthetic peptide
  MOD_RES (2)..(2): Aib
  MOD_RES (6)..(6): Me-Phe
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Aib
  MOD_RES (21)..(21): Lys(C16)
  MOD_RES (23)..(23): Ac5c
  C-term amide
HXQGTFTSDYSEYLDKRXAQKFX

SEQ ID NO: 456 - protein, 23 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Aib
  MOD_RES (21)..(21): Lys(C8)
  MOD_RES (23)..(23): Ac5c
  C-term amide
HXQGTFTSDYSEYLDKRXAQKFX

SEQ ID NO: 457 - protein, 23 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Aib
  MOD_RES (21)..(21): Lys(C12)
  MOD_RES (23)..(23): Ac5c
  C-term amide
HXQGTFTSDYSEYLDKRXAQKFX

SEQ ID NO: 458 - protein, 23 aa, Artificial Sequence
  Description of Artificial Sequence: Synthetic peptide
  MOD_RES (2)..(2): Aib
  MOD_RES (12)..(12): Glu is cyclized through side chain to form a lactam linkage
  MOD_RES (16)..(16): Lys is cyclized through side chain to form a lactam linkage
  MOD_RES (18)..(18): Aib
  MOD_RES (21)..(21): Lys(C16)
  MOD_RES (23)..(23): Ac5c
  C-term amide
HXQGTFTSDYSEYLDKRXAQKFX

SEQ ID NO: 459 - protein, 23 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Aib
  MOD_RES (21)..(21): Lys(C8)
  MOD_RES (23)..(23): Aib
  C-term amide
HXQGTFTSDYSEYLDKRXAQKFX

SEQ ID NO: 460 - protein, 23 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Aib
  MOD_RES (21)..(21): Lys(C12)
  MOD_RES (23)..(23): Aib
  C-term amide
HXQGTFTSDYSEYLDKRXAQKFX

SEQ ID NO: 461 - protein, 23 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Aib
  MOD_RES (21)..(21): Lys(C16)
  MOD_RES (23)..(23): Aib
  C-term amide
HXQGTFTSDYSEYLDKRXAQKFX

SEQ ID NO: 462 - protein, 23 aa, Artificial Sequence
  Description of Artificial Sequence: Synthetic peptide
  MOD_RES (2)..(2): Aib
  MOD_RES (6)..(6): Me-Phe
  misc_feature (16)..(20): Cyclic
  MOD_RES (16)..(16): Glu is cyclized through side chain to form a lactam linkage
  MOD_RES (18)..(18): Aib
  MOD_RES (20)..(20): Lys is cyclized through side chain to form a lactam linkage
  MOD_RES (21)..(21): Lys(C8)
  MOD_RES (23)..(23): Aib
  C-term amide
HXQGTFTSDYSKYLDERXAKKFX

SEQ ID NO: 463 - protein, 23 aa, Artificial Sequence
  Description of Artificial Sequence: Synthetic peptide
  MOD_RES (2)..(2): Aib
  MOD_RES (6)..(6): Me-Phe
  misc_feature (16)..(20): Cyclic
  MOD_RES (16)..(16): Glu is cyclized through side chain to form a lactam linkage
  MOD_RES (18)..(18): Aib
  MOD_RES (20)..(20): Lys is cyclized through side chain to form a lactam linkage
  MOD_RES (21)..(21): Lys(C12)
  MOD_RES (23)..(23): Aib
  C-term amide
HXQGTFTSDYSKYLDERXAKKFX

SEQ ID NO: 464 - protein, 23 aa, Artificial Sequence
  Description of Artificial Sequence: Synthetic peptide
  MOD_RES (2)..(2): Aib
  MOD_RES (6)..(6): Me-Phe
  MOD_RES (16)..(16): Glu is cyclized through side chain to form a lactam linkage
  MOD_RES (18)..(18): Aib
  MOD_RES (20)..(20): Lys is cyclized through side chain to form a lactam linkage
  MOD_RES (21)..(21): Lys(C16)
  MOD_RES (23)..(23): Aib
  C-term amide
HXQGTFTSDYSKYLDERXAKKFX

SEQ ID NO: 465 - protein, 23 aa, Artificial Sequence
  Description of Artificial Sequence: Synthetic peptide
  MOD_RES (2)..(2): Aib
  MOD_RES (6)..(6): Me-Phe
  misc_feature (16)..(20): Cyclic
  MOD_RES (16)..(16): Glu is cyclized through side chain to form a lactam linkage
  MOD_RES (18)..(18): Aib
  MOD_RES (20)..(20): Lys is cyclized through side chain to form a lactam linkage
  MOD_RES (21)..(21): Lys(C8)
  MOD_RES (23)..(23): Ac5c
  C-term amide
HXQGTFTSDYSKYLDERXAKKFX

SEQ ID NO: 466 - protein, 23 aa, Artificial Sequence
  Description of Artificial Sequence: Synthetic peptide
  MOD_RES (2)..(2): Aib
  MOD_RES (6)..(6): Me-Phe
  MOD_RES (16)..(16): Lys is cyclized through side chain to form a lactam linkage
  MOD_RES (18)..(18): Aib
  MOD_RES (20)..(20): Lys is cyclized through side chain to form a lactam linkage
  MOD_RES (21)..(21): Lys(C12)
  MOD_RES (23)..(23): Ac5c
  C-term amide
HXQGTFTSDYSKYLDKRXAKKFX

SEQ ID NO: 467 - protein, 23 aa, Artificial Sequence
  Description of Artificial Sequence: Synthetic peptide
  MOD_RES (2)..(2): Aib
  MOD_RES (6)..(6): Me-Phe
  MOD_RES (16)..(16): Lys is cyclized through side chain to form a lactam linkage
  MOD_RES (18)..(18): Aib
  MOD_RES (20)..(20): Lys is cyclized through side chain to form a lactam linkage
  MOD_RES (21)..(21): Lys(C16)
  MOD_RES (23)..(23): Ac5c
  C-term amide
HXQGTFTSDYSKYLDKRXAKKFX

SEQ ID NO: 468 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (18)..(18): Aib
  MOD_RES (20)..(20): Lys is cyclized through side chain to form a lactam linkage
  MOD_RES (21)..(21): Lys(C8)
  MOD_RES (23)..(23): Aib
  C-term amide
HXQGTFTSDYSKYLDERXAKKFX

SEQ ID NO: 469 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (18)..(18): Aib
  MOD_RES (20)..(20): Lys is cyclized through side chain to form a lactam linkage
  MOD_RES (21)..(21): Lys(C12)
  MOD_RES (23)..(23): Aib
  C-term amide
HXQGTFTSDYSKYLDERXAKKFX

SEQ ID NO: 470 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (18)..(18): Aib
  MOD_RES (20)..(20): Lys is cyclized through side chain to form a lactam linkage
  MOD_RES (21)..(21): Lys(C16)
  MOD_RES (23)..(23): Aib
  C-term amide
HXQGTFTSDYSKYLDERXAKKFX

SEQ ID NO: 471 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (18)..(18): Aib
  MOD_RES (20)..(20): Lys is cyclized through side chain to form a lactam linkage
  MOD_RES (21)..(21): Lys(C8)
  MOD_RES (23)..(23): Ac5c
  C-term amide
HXQGTFTSDYSKYLDERXAKKFX

SEQ ID NO: 472 - protein, 23 aa, Artificial Sequence
  Description of Artificial Sequence: Synthetic peptide
  MOD_RES (2)..(2): Aib
  MOD_RES (16)..(16): Lys is cyclized through side chain to form a lactam linkage
  MOD_RES (18)..(18): Aib
  MOD_RES (20)..(20): Lys is cyclized through side chain to form a lactam linkage
  MOD_RES (21)..(21): Lys(C12)
  MOD_RES (23)..(23): Ac5c
  C-term amide
HXQGTFTSDYSKYLDKRXAKKFX

SEQ ID NO: 473 - protein, 23 aa, Artificial Sequence
  Description of Artificial Sequence: Synthetic peptide
  MOD_RES (2)..(2): Aib
  MOD_RES (16)..(16): Lys is cyclized through side chain to form a lactam linkage
  MOD_RES (18)..(18): Aib
  MOD_RES (20)..(20): Lys is cyclized through side chain to form a lactam linkage
  MOD_RES (21)..(21): Lys(C16)
  MOD_RES (23)..(23): Ac5c
  C-term amide
HXQGTFTSDYSKYLDKRXAKKFX

SEQ ID NO: 474 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (21)..(21): Lys(C12)
  MOD_RES (23)..(23): Aib
  C-term amide
HXQGTFTSDYSKYLDEQAAKKFX

SEQ ID NO: 475 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (21)..(21): Lys(C16)
  MOD_RES (23)..(23): Aib
  C-term amide
HXQGTFTSDYSKYLDEQAAKKFX

SEQ ID NO: 476 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (21)..(21): Lys(C12)
  MOD_RES (23)..(23): Aib
  C-term amide
HXQGTFTSDYSKYLDERAAKKFX

SEQ ID NO: 477 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (21)..(21): Lys(C16)
  MOD_RES (23)..(23): Aib
  C-term amide
HXQGTFTSDYSKYLDERAAKKFX

SEQ ID NO: 478 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (21)..(21): Lys(C12)
  MOD_RES (23)..(23): Ac5c
  C-term amide
HXQGTFTSDYSKYLDERAAKKFX

SEQ ID NO: 479 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (21)..(21): Lys(C16)
  MOD_RES (23)..(23): Ac5c
  C-term amide
HXQGTFTSDYSKYLDERAAKKFX

SEQ ID NO: 480 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (21)..(21): Lys(C12)
  MOD_RES (23)..(23): Ac5c
  C-term amide
HXQGTFTSDYSKYLDEQAAKKFX

SEQ ID NO: 481 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (21)..(21): Lys(C12)
  MOD_RES (23)..(23): Aib
  C-term amide
HXQGTFTSDYSRYLDERAAKKFX

SEQ ID NO: 482 - protein, 19 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C12)
  MOD_RES (19)..(19): Aib
  C-term amide
HXQGTFTSDYSKYLDSXKX

SEQ ID NO: 483 - protein, 19 aa, Artificial Sequence
  Description of Artificial Sequence: Synthetic peptide
  MOD_RES (2)..(2): Aib
  MOD_RES (18)..(18): Lys(C12)
  MOD_RES (19)..(19): Aib
  C-term amide
HXQGTFTSDYSKYLDSRKX

SEQ ID NO: 484 - protein, 19 aa, Artificial Sequence
  Description of Artificial Sequence: Synthetic peptide
  MOD_RES (2)..(2): Aib
  MOD_RES (18)..(18): Lys(C12)
  MOD_RES (19)..(19): Ac5c
  C-term amide
HXQGTFTSDYSKYLDSRKX

SEQ ID NO: 485 - protein, 19 aa, Artificial Sequence
  Description of Artificial Sequence: Synthetic peptide
  MOD_RES (2)..(2): Aib
  MOD_RES (18)..(18): Lys(C8)
  MOD_RES (19)..(19): Aib
  C-term amide
HXQGTFTSDYSKYLDSRKX

SEQ ID NO: 486 - protein, 19 aa, Artificial Sequence
  Description of Artificial Sequence: Synthetic peptide
  MOD_RES (2)..(2): Aib
  MOD_RES (18)..(18): Lys(C16)
  MOD_RES (19)..(19): Aib
  C-term amide
HXQGTFTSDYSKYLDSRKX

SEQ ID NO: 487 - protein, 19 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C12)
  MOD_RES (19)..(19): Aib
  C-term amide
HXQGTFTSDYSKYLDSXKX

SEQ ID NO: 488 - protein, 19 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C8)
  MOD_RES (19)..(19): Aib
  C-term amide
HXQGTFTSDYSKYLDSXKX

SEQ ID NO: 489 - protein, 19 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C1)
  MOD_RES (19)..(19): Aib
  C-term amide
HXQGTFTSDYSKYLDSXKX

SEQ ID NO: 490 - protein, 19 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C16)
  MOD_RES (19)..(19): Aib
  C-term amide
HXQGTFTSDYSKYLDSXKX

SEQ ID NO: 491 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (17)..(17): Aib
  MOD_RES (18)..(18): Lys(C16)
  MOD_RES (19)..(19): Aib
  C-term amide
HXQGTFTSDYSKYLDEXKX

SEQ ID NO: 492 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (17)..(17): Aib
  MOD_RES (18)..(18): Lys(C12)
  MOD_RES (19)..(19): Aib
  C-term amide
HXQGTFTSDYSKYLDEXKX

SEQ ID NO: 493 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (17)..(17): Aib
  MOD_RES (18)..(18): Lys(C8)
  MOD_RES (19)..(19): Aib
  C-term amide
HXQGTFTSDYSKYLDEXKX

SEQ ID NO: 494 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C16)
  MOD_RES (19)..(19): Aib
  C-term amide
HXQGTFTSDYSKYLDERKX

SEQ ID NO: 495 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C12)
  MOD_RES (19)..(19): Aib
  C-term amide
HXQGTFTSDYSKYLDERKX

SEQ ID NO: 496 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C8)
  MOD_RES (19)..(19): Aib
  C-term amide
HXQGTFTSDYSKYLDERKX

SEQ ID NO: 497 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C12)
  MOD_RES (19)..(19): Ac5c
  C-term amide
HXQGTFTSDYSKYLDERKX

SEQ ID NO: 498 - protein, 18 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C8)
  C-term amide
HXQGTFTSDYSKYLDRXK

SEQ ID NO: 499 - protein, 18 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C12)
  C-term amide
HXQGTFTSDYSKYLDRXK

SEQ ID NO: 500 - protein, 18 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C16)
  C-term amide
HXQGTFTSDYSKYLDRXK

SEQ ID NO: 501 - protein, 19 aa, Artificial Sequence
  Description of Artificial Sequence: Synthetic peptide
  MOD_RES (2)..(2): Aib
  MOD_RES (18)..(18): Aib
  MOD_RES (19)..(19): Lys(C8)
  C-term amide
HXQGTFTSDYSKYLDSRXK

SEQ ID NO: 502 - protein, 19 aa, Artificial Sequence
  Description of Artificial Sequence: Synthetic peptide
  MOD_RES (2)..(2): Aib
  MOD_RES (18)..(18): Aib
  MOD_RES (19)..(19): Lys(C12)
  C-term amide
HXQGTFTSDYSKYLDSRXK

SEQ ID NO: 503 - protein, 19 aa, Artificial Sequence
  Description of Artificial Sequence: Synthetic peptide
  MOD_RES (2)..(2): Aib
  MOD_RES (18)..(18): Aib
  MOD_RES (19)..(19): Lys(C16)
  C-term amide
HXQGTFTSDYSKYLDSRXK

SEQ ID NO: 504 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(18): Aib
  MOD_RES (19)..(19): Lys(C8)
  C-term amide
HXQGTFTSDYSKYLDXRXK

SEQ ID NO: 505 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(18): Aib
  MOD_RES (19)..(19): Lys(C12)
  C-term amide
HXQGTFTSDYSKYLDXRXK

SEQ ID NO: 506 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(18): Aib
  MOD_RES (19)..(19): Lys(C16)
  C-term amide
HXQGTFTSDYSKYLDXRXK

SEQ ID NO: 507 - protein, 18 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C8)
  C-term amide
HXQGTFTSDVSSYLERXK

SEQ ID NO: 508 - protein, 18 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C12)
  C-term amide
HXQGTFTSDVSSYLERXK

SEQ ID NO: 509 - protein, 18 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C16)
  C-term amide
HXQGTFTSDVSSYLERXK

SEQ ID NO: 510 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(19): Lys(C8)
  C-term amide
HXQGTFTSDVSSYLEXRKK

SEQ ID NO: 511 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(19): Lys(C12)
  C-term amide
HXQGTFTSDVSSYLEXRKK

SEQ ID NO: 512 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(19): Lys(C16)
  C-term amide
HXQGTFTSDVSSYLEXRKK

SEQ ID NO: 513 - protein, 18 aa, Artificial Sequence
  Description of Artificial Sequence: Synthetic peptide
  MOD_RES (2)..(2): Aib
  MOD_RES (16)..(16): hArg
  MOD_RES (17)..(17): Aib
  MOD_RES (18)..(18): Lys(C8)
  C-term amide
HXQGTFTSDYSKYLDRXK

SEQ ID NO: 514 - protein, 18 aa, Artificial Sequence
  Description of Artificial Sequence: Synthetic peptide
  MOD_RES (2)..(2): Aib
  MOD_RES (16)..(16): hArg
  MOD_RES (17)..(17): Aib
  MOD_RES (18)..(18): Lys(C12)
  C-term amide
HXQGTFTSDYSKYLDRXK

SEQ ID NO: 515 - protein, 18 aa, Artificial Sequence
  Description of Artificial Sequence: Synthetic peptide
  MOD_RES (2)..(2): Aib
  MOD_RES (16)..(16): hArg
  MOD_RES (17)..(17): Aib
  MOD_RES (18)..(18): Lys(C16)
  C-term amide
HXQGTFTSDYSKYLDRXK

SEQ ID NO: 516 - protein, 19 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Aib
  MOD_RES (19)..(19): Lys(C8)
  C-term amide
HXQGTFTSDYSKYLDXRXK

SEQ ID NO: 517 - protein, 19 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Aib
  MOD_RES (19)..(19): Lys(C12)
  C-term amide
HXQGTFTSDYSKYLDXRXK

SEQ ID NO: 518 - protein, 19 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Aib
  MOD_RES (19)..(19): Lys(C16)
  C-term amide
HXQGTFTSDYSKYLDXRXK

SEQ ID NO: 519 - protein, 18 aa, Artificial Sequence
  Description of Artificial Sequence: Synthetic peptide
  MOD_RES (2)..(2): Aib
  MOD_RES (16)..(16): hArg
  MOD_RES (17)..(17): Aib
  MOD_RES (18)..(18): Lys(C8)
  C-term amide
HXQGTFTSDVSSYLERXK

SEQ ID NO: 520 - protein, 18 aa, Artificial Sequence
  Description of Artificial Sequence: Synthetic peptide
  MOD_RES (2)..(2): Aib
  MOD_RES (16)..(16): hArg
  MOD_RES (17)..(17): Aib
  MOD_RES (18)..(18): Lys(C12)
  C-term amide
HXQGTFTSDVSSYLERXK

SEQ ID NO: 521 - protein, 22 aa, Artificial Sequence
  Description of Artificial Sequence: Synthetic peptide
  MOD_RES (21)..(21): Lys(C12)
  MOD_RES (22)..(22): Aib
  C-term amide
HSQGTFTSDYSKYLDSRRAQKX

SEQ ID NO: 522 - protein, 21 aa, Artificial Sequence
  Description of Artificial Sequence: Synthetic peptide
  MOD_RES (20)..(20): Lys(C12)
  MOD_RES (21)..(21): Aib
  C-term amide
HSQGTFTSDYSKYLDSRRAKX

SEQ ID NO: 523 - protein, 20 aa, Artificial Sequence
  Description of Artificial Sequence: Synthetic peptide
  MOD_RES (19)..(19): Lys(C12)
  MOD_RES (20)..(20): Aib
  C-term amide
HSQGTFTSDYSKYLDSRRKX

SEQ ID NO: 524 - protein, 19 aa, Artificial Sequence
  Description of Artificial Sequence: Synthetic peptide
  MOD_RES (18)..(18): Lys(C12)
  MOD_RES (19)..(19): Aib
  C-term amide
HSQGTFTSDYSKYLDSRKX

SEQ ID NO: 525 - protein, 18 aa, Artificial Sequence
  Description of Artificial Sequence: Synthetic peptide
  MOD_RES (17)..(17): Lys(C12)
  MOD_RES (18)..(18): Aib
  C-term amide
HSQGTFTSDYSKYLDSKX

SEQ ID NO: 526 - protein, 17 aa, Artificial Sequence
  Description of Artificial Sequence: Synthetic peptide
  MOD_RES (16)..(16): Lys(C12)
  MOD_RES (17)..(17): Aib
  C-term amide
HSQGTFTSDYSKYLDKX

SEQ ID NO: 527 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C12)
  C-term amide
HXQGTFTSDYSKYLDEQAAKEFIKWLMNT

SEQ ID NO: 528 - protein, 21 aa, Artificial Sequence
  Description of Artificial Sequence: Synthetic peptide
  MOD_RES (21)..(21): Lys(C12)
  C-term amide
HSQGTFTSDYSKYLDSRRAQK

SEQ ID NO: 529 - protein, 20 aa, Artificial Sequence
  Description of Artificial Sequence: Synthetic peptide
  MOD_RES (20)..(20): Lys(C12)
  C-term amide
HSQGTFTSDYSKYLDSRRAK

SEQ ID NO: 530 - protein, 19 aa, Artificial Sequence
  Description of Artificial Sequence: Synthetic peptide
  MOD_RES (19)..(19): Lys(C12)
  C-term amide
HSQGTFTSDYSKYLDSRRK

SEQ ID NO: 531 - protein, 18 aa, Artificial Sequence
  Description of Artificial Sequence: Synthetic peptide
  MOD_RES (18)..(18): Lys(C12)
  C-term amide
HSQGTFTSDYSKYLDSRK

SEQ ID NO: 532 - protein, 17 aa, Artificial Sequence
  Description of Artificial Sequence: Synthetic peptide
  MOD_RES (17)..(17): Lys(C12)
  C-term amide
HSQGTFTSDYSKYLDSK

SEQ ID NO: 533 - protein, 16 aa, Artificial Sequence
  Description of Artificial Sequence: Synthetic peptide
  MOD_RES (16)..(16): Lys(C12)
  C-term amide
HSQGTFTSDYSKYLDK

SEQ ID NO: 534 - protein, 21 aa, Artificial Sequence
  Description of Artificial Sequence: Synthetic peptide
  MOD_RES (20)..(20): Lys(C12)
  MOD_RES (21)..(21): Aib
  C-term amide
HAEGTFTSDVSSYLEGQAAKX

SEQ ID NO: 535 - protein, 20 aa, Artificial Sequence
  Description of Artificial Sequence: Synthetic peptide
  MOD_RES (19)..(19): Lys(C12)
  MOD_RES (20)..(20): Aib
  C-term amide
HAEGTFTSDVSSYLEGQAKX

SEQ ID NO: 536 - protein, 19 aa, Artificial Sequence
  Description of Artificial Sequence: Synthetic peptide
  MOD_RES (18)..(18): Lys(C12)
  MOD_RES (19)..(19): Aib
  C-term amide
HAEGTFTSDVSSYLEGQKX

SEQ ID NO: 537 - protein, 18 aa, Artificial Sequence
  Description of Artificial Sequence: Synthetic peptide
  MOD_RES (17)..(17): Lys(C12)
  MOD_RES (18)..(18): Aib
  C-term amide
HAEGTFTSDVSSYLEGKX

SEQ ID NO: 538 - protein, 17 aa, Artificial Sequence
  Description of Artificial Sequence: Synthetic peptide
  MOD_RES (16)..(16): Lys(C12)
  MOD_RES (17)..(17): Aib
  C-term amide
HAEGTFTSDVSSYLEKX

SEQ ID NO: 539 - protein, 16 aa, Artificial Sequence
  Description of Artificial Sequence: Synthetic peptide
  MOD_RES (15)..(15): Lys(C12)
  MOD_RES (16)..(16): Aib
  C-term amide
HAEGTFTSDVSSYLKX

SEQ ID NO: 540 - protein, 17 aa, Artificial Sequence
  Description of Artificial Sequence: Synthetic peptide
  MOD_RES (2)..(2): Aib
  MOD_RES (16)..(16): Lys(C12)
  MOD_RES (17)..(17): Aib
  C-term amide
HXQGTFTSDYSKYLDKX

SEQ ID NO: 541 - protein, 17 aa, Artificial Sequence
  Description of Artificial Sequence: Synthetic peptide
  MOD_RES (2)..(2): Aib
  MOD_RES (16)..(16): Lys(C12)
  MOD_RES (17)..(17): Ac4c
  C-term amide
HXQGTFTSDYSKYLDKX

SEQ ID NO: 542 - protein, 19 aa, Artificial Sequence
  Description of Artificial Sequence: Synthetic peptide
  MOD_RES (2)..(2): Aib
  MOD_RES (16)..(16): Lys(C12)
  MOD_RES (19)..(19): Aib
  C-term amide
HXQGTFTSDYSKYLDKRRX

SEQ ID NO: 543 - protein, 18 aa, Artificial Sequence
  Description of Artificial Sequence: Synthetic peptide
  MOD_RES (2)..(2): Aib
  MOD_RES (16)..(16): Lys(C12)
  MOD_RES (17)..(17): Aib
  C-term amide
HXQGTFTSDYSKYLDKXR

SEQ ID NO: 544 - protein, 18 aa, Artificial Sequence
  Description of Artificial Sequence: Synthetic peptide
  MOD_RES (2)..(2): Aib
  MOD_RES (16)..(16): Lys(C12)
  MOD_RES (18)..(18): Aib
  C-term amide
HXQGTFTSDYSKYLDKRX

SEQ ID NO: 545 - protein, 18 aa, Artificial Sequence
  Description of Artificial Sequence: Synthetic peptide
  MOD_RES (2)..(2): Aib
  MOD_RES (16)..(16): Lys(C12)
  MOD_RES (17)..(17): hArg
  MOD_RES (18)..(18): Aib
  C-term amide
HXQGTFTSDYSKYLDKRX

SEQ ID NO: 546 - protein, 18 aa, Artificial Sequence
  Description of Artificial Sequence: Synthetic peptide
  MOD_RES (2)..(2): Aib
  MOD_RES (17)..(17): Lys(C12)
  MOD_RES (18)..(18): Aib
  C-term amide
HXQGTFTSDYSKYLDSKX

SEQ ID NO: 547 - protein, 18 aa, Artificial Sequence
  Description of Artificial Sequence: Synthetic peptide
  MOD_RES (2)..(2): Aib
  MOD_RES (17)..(17): Lys(C12)
  MOD_RES (18)..(18): Ac4c
  C-term amide
HXQGTFTSDYSKYLDSKX

SEQ ID NO: 548 - protein, 19 aa, Artificial Sequence
  Description of Artificial Sequence: Synthetic peptide
  MOD_RES (2)..(2): Aib
  MOD_RES (17)..(17): Lys(C12)
  MOD_RES (19)..(19): Aib
  C-term amide
HXQGTFTSDYSKYLDSKRX

SEQ ID NO: 549 - protein, 19 aa, Artificial Sequence
  Description of Artificial Sequence: Synthetic peptide
  MOD_RES (2)..(2): Aib
  MOD_RES (17)..(17): Lys(C12)
  MOD_RES (18)..(18): hArg
  MOD_RES (19)..(19): Aib
  C-term amide
HXQGTFTSDYSKYLDSKRX

SEQ ID NO: 550 - protein, 19 aa, Artificial Sequence
  Description of Artificial Sequence: Synthetic peptide
  MOD_RES (2)..(2): Aib
  MOD_RES (18)..(18): Lys(C12)
  MOD_RES (19)..(19): Aib
  C-term amide
HXQGTFTSDYSKYLDSRKX

SEQ ID NO: 551 - protein, 19 aa, Artificial Sequence
  Description of Artificial Sequence: Synthetic peptide
  MOD_RES (2)..(2): Aib
  MOD_RES (18)..(18): Lys(C12)
  MOD_RES (19)..(19): Ac4c
  C-term amide
HXQGTFTSDYSKYLDSRKX

SEQ ID NO: 552 - protein, 19 aa, Artificial Sequence
  Description of Artificial Sequence: Synthetic peptide
  MOD_RES (2)..(2): Aib
  MOD_RES (17)..(17): hArg
  MOD_RES (18)..(18): Lys(C12)
  MOD_RES (19)..(19): Aib
  C-term amide
HXQGTFTSDYSKYLDSRKX

SEQ ID NO: 553 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C12)
  MOD_RES (19)..(19): Aib
  C-term amide
HXQGTFTSDYSKYLDXRKX

SEQ ID NO: 554 - protein, 19 aa, Artificial Sequence
  Description of Artificial Sequence: Synthetic peptide
  MOD_RES (2)..(2): Aib
  MOD_RES (18)..(18): Lys(C14)
  MOD_RES (19)..(19): Aib
  C-term amide
HXQGTFTSDYSKYLDSRKX

SEQ ID NO: 555 - protein, 19 aa, Artificial Sequence
  Description of Artificial Sequence: Synthetic peptide
  MOD_RES (2)..(2): Aib
  MOD_RES (18)..(18): Lys(C16)
  MOD_RES (19)..(19): Aib
  C-term amide
HXQGTFTSDYSKYLDSRKX

SEQ ID NO: 556 - protein, 19 aa, Artificial Sequence
  Description of Artificial Sequence: Synthetic peptide
  MOD_RES (2)..(2): Aib
  MOD_RES (18)..(18): Lys(C18)
  MOD_RES (19)..(19): Aib
  C-term amide
HXQGTFTSDYSKYLDSRKX

SEQ ID NO: 557 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C12)
  MOD_RES (19)..(19): Aib
  C-term amide
HXQGTFTSDYSKYLDXQKX

SEQ ID NO: 558 - protein, 20 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (18)..(18): Lys(C12)
  MOD_RES (20)..(20): Lys is cyclized through side chain to form a lactam linkage
  C-term amide
HXQGTFTSDYSKYLDEQKAK

SEQ ID NO: 559 - protein, 20 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (18)..(18): Lys(C14)
  MOD_RES (20)..(20): Lys is cyclized through side chain to form a lactam linkage
  C-term amide
HXQGTFTSDYSKYLDEQKAK

SEQ ID NO: 560 - protein, 20 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (18)..(18): Lys(C16)
  MOD_RES (20)..(20): Lys is cyclized through side chain to form a lactam linkage
  C-term amide
HXQGTFTSDYSKYLDEQKAK

SEQ ID NO: 561 - protein, 20 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (18)..(18): Lys(C18)
  MOD_RES (20)..(20): Lys is cyclized through side chain to form a lactam linkage
  C-term amide
HXQGTFTSDYSKYLDEQKAK

SEQ ID NO: 562 - protein, 20 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (18)..(18): Lys(C20)
  MOD_RES (20)..(20): Lys is cyclized through side chain to form a lactam linkage
  C-term amide
HXQGTFTSDYSKYLDEQKAK

SEQ ID NO: 563 - protein, 20 aa, Artificial Sequence
  Description of Artificial Sequence: Synthetic peptide
  MOD_RES (2)..(2): Aib
  MOD_RES (18)..(18): Lys(C12)
  MOD_RES (19)..(20): Aib
  C-term amide
HXQGTFTSDYSKYLDSRKXX

SEQ ID NO: 564 - protein, 20 aa, Artificial Sequence
  Description of Artificial Sequence: Synthetic peptide
  MOD_RES (2)..(2): Aib
  MOD_RES (18)..(18): Lys(C14)
  MOD_RES (19)..(20): Aib
  C-term amide
HXQGTFTSDYSKYLDSRKXX

SEQ ID NO: 565 - protein, 20 aa, Artificial Sequence
  Description of Artificial Sequence: Synthetic peptide
  MOD_RES (2)..(2): Aib
  MOD_RES (18)..(18): Lys(C16)
  MOD_RES (19)..(20): Aib
  C-term amide
HXQGTFTSDYSKYLDSRKXX

SEQ ID NO: 566 - protein, 20 aa, Artificial Sequence
  Description of Artificial Sequence: Synthetic peptide
  MOD_RES (2)..(2): Aib
  MOD_RES (18)..(18): Lys(C18)
  MOD_RES (19)..(20): Aib
  C-term amide
HXQGTFTSDYSKYLDSRKXX

SEQ ID NO: 567 - protein, 20 aa, Artificial Sequence
  Description of Artificial Sequence: Synthetic peptide
  MOD_RES (2)..(2): Aib
  MOD_RES (18)..(18): Lys(C20)
  MOD_RES (19)..(20): Aib
  C-term amide
HXQGTFTSDYSKYLDSRKXX

SEQ ID NO: 568 - protein, 18 aa, Artificial Sequence
  Description of Artificial Sequence: Synthetic peptide
  MOD_RES (2)..(2): Aib
  MOD_RES (16)..(17): Aib
  MOD_RES (18)..(18): Lys(C12)
  C-term amide
HXQGTFTSDYSKYLDXXK

SEQ ID NO: 569 - protein, 18 aa, Artificial Sequence
  Description of Artificial Sequence: Synthetic peptide
  MOD_RES (2)..(2): Aib
  MOD_RES (16)..(17): Aib
  MOD_RES (18)..(18): Lys(C14)
  C-term amide
HXQGTFTSDYSKYLDXXK

SEQ ID NO: 570 - protein, 18 aa, Artificial Sequence
  Description of Artificial Sequence: Synthetic peptide
  MOD_RES (2)..(2): Aib
  MOD_RES (16)..(17): Aib
  MOD_RES (18)..(18): Lys(C16)
  C-term amide
HXQGTFTSDYSKYLDXXK

SEQ ID NO: 571 - protein, 18 aa, Artificial Sequence
  Description of Artificial Sequence: Synthetic peptide
  MOD_RES (2)..(2): Aib
  MOD_RES (16)..(17): Aib
  MOD_RES (18)..(18): Lys(C18)
  C-term amide
HXQGTFTSDYSKYLDXXK

SEQ ID NO: 572 - protein, 18 aa, Artificial Sequence
  Description of Artificial Sequence: Synthetic peptide
  MOD_RES (2)..(2): Aib
  MOD_RES (16)..(17): Aib
  MOD_RES (18)..(18): Lys(C20)
  C-term amide
HXQGTFTSDYSKYLDXXK

SEQ ID NO: 573 - protein, 20 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C12)
  MOD_RES (19)..(20): Aib
  C-term amide
HXQGTFTSDYSKYLDSXKXX

SEQ ID NO: 574 - protein, 20 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C14)
  MOD_RES (19)..(20): Aib
  C-term amide
HXQGTFTSDYSKYLDSXKXX

SEQ ID NO: 575 - protein, 20 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C16)
  MOD_RES (19)..(20): Aib
  C-term amide
HXQGTFTSDYSKYLDSXKXX

SEQ ID NO: 576 - protein, 20 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C18)
  MOD_RES (19)..(20): Aib
  C-term amide
HXQGTFTSDYSKYLDSXKXX

SEQ ID NO: 577 - protein, 20 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C20)
  MOD_RES (19)..(20): Aib
  C-term amide
HXQGTFTSDYSKYLDSXKXX

SEQ ID NO: 578 - protein, 20 aa, Artificial Sequence
  Description of Artificial Sequence: Synthetic peptide
  MOD_RES (2)..(2): Aib
  MOD_RES (17)..(17): Aib
  MOD_RES (18)..(18): Lys(C22)
  MOD_RES (19)..(20): Aib
  C-term amide
HXQGTFTSDYSKYLDSXKXX

SEQ ID NO: 579 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C12)
  MOD_RES (19)..(19): Aib
  C-term amide
HXQGTFTSDYSKYLDERKX

SEQ ID NO: 580 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C14)
  MOD_RES (19)..(19): Aib
  C-term amide
HXQGTFTSDYSKYLDERKX

SEQ ID NO: 581 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C16)
  MOD_RES (19)..(19): Aib
  C-term amide
HXQGTFTSDYSKYLDERKX

SEQ ID NO: 582 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C18)
  MOD_RES (19)..(19): Aib
  C-term amide
HXQGTFTSDYSKYLDERKX

SEQ ID NO: 583 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C20)
  MOD_RES (19)..(19): Aib
  C-term amide
HXQGTFTSDYSKYLDERKX

SEQ ID NO: 584 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C12)
  MOD_RES (19)..(19): Aib
  C-term amide
HXQGTFTSDYSKYLDEQKX

SEQ ID NO: 585 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  MOD_RES (16)..(16): Glu is cyclized through side chain to form a lactam linkage
  MOD_RES (18)..(18): Lys(C14)
  MOD_RES (19)..(19): Aib
  C-term amide
HXQGTFTSDYSKYLDEQKX

SEQ ID NO: 586 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C16)
  MOD_RES (19)..(19): Aib
  C-term amide
HXQGTFTSDYSKYLDEQKX

SEQ ID NO: 587 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C18)
  MOD_RES (19)..(19): Aib
  C-term amide
HXQGTFTSDYSKYLDEQKX

SEQ ID NO: 588 - protein, 19 aa, Artificial Sequence
  Description of Artificial Sequence: Synthetic peptide
  MOD_RES (2)..(2): Aib
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C20)
  MOD_RES (19)..(19): Aib
  C-term amide
HXQGTFTSDYSKYLDEQKX

SEQ ID NO: 589 - protein, 20 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Lys(C12)
  MOD_RES (19)..(20): Aib
  C-term amide
HXQGTFTSDYSEYLDKRKXX

SEQ ID NO: 590 - protein, 20 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Lys(C14)
  MOD_RES (19)..(20): Aib
  C-term amide
HXQGTFTSDYSEYLDKRKXX

SEQ ID NO: 591 - protein, 20 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Lys(C16)
  MOD_RES (19)..(20): Aib
  C-term amide
HXQGTFTSDYSEYLDKRKXX

SEQ ID NO: 592 - protein, 20 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Lys(C18)
  MOD_RES (19)..(20): Aib
  C-term amide
HXQGTFTSDYSEYLDKRKXX

SEQ ID NO: 593 - protein, 20 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Lys(C20)
  MOD_RES (19)..(20): Aib
  C-term amide
HXQGTFTSDYSEYLDKRKXX

SEQ ID NO: 594 - protein, 20 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): hArg
  MOD_RES (18)..(18): Lys(C12)
  MOD_RES (19)..(20): Aib
  C-term amide
HXQGTFTSDYSEYLDKRKXX

SEQ ID NO: 595 - protein, 20 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): hArg
  MOD_RES (18)..(18): Lys(C14)
  MOD_RES (19)..(20): Aib
  C-term amide
HXQGTFTSDYSEYLDKRKXX

SEQ ID NO: 596 - protein, 20 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): hArg
  MOD_RES (18)..(18): Lys(C16)
  MOD_RES (19)..(20): Aib
  C-term amide
HXQGTFTSDYSEYLDKRKXX

SEQ ID NO: 597 - protein, 20 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): hArg
  MOD_RES (18)..(18): Lys(C18)
  MOD_RES (19)..(20): Aib
  C-term amide
HXQGTFTSDYSEYLDKRKXX

SEQ ID NO: 598 - protein, 20 aa, Artificial Sequence
  Description of Artificial Sequence: Synthetic peptide
  MOD_RES (2)..(2): Aib
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): hArg
  MOD_RES (18)..(18): Lys(C20)
  MOD_RES (19)..(20): Aib
  C-term amide
HXQGTFTSDYSEYLDKRKXX

SEQ ID NO: 599 - protein, 20 aa, Artificial Sequence
  Description of Artificial Sequence: Synthetic peptide
  MOD_RES (2)..(2): Ac4c
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C12)
  MOD_RES (19)..(20): Aib
  C-term amide
HXQGTFTSDYSKYLDERKXX

SEQ ID NO: 600 - protein, 20 aa, Artificial Sequence
  Description of Artificial Sequence: Synthetic peptide
  MOD_RES (2)..(2): Ac4c
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C14)
  MOD_RES (19)..(20): Aib
  C-term amide
HXQGTFTSDYSKYLDERKXX

SEQ ID NO: 601 - protein, 20 aa, Artificial Sequence
  Description of Artificial Sequence: Synthetic peptide
  MOD_RES (2)..(2): Ac4c
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C16)
  MOD_RES (19)..(20): Aib
  C-term amide
HXQGTFTSDYSKYLDERKXX

SEQ ID NO: 602 - protein, 20 aa, Artificial Sequence
  Description of Artificial Sequence: Synthetic peptide
  MOD_RES (2)..(2): Ac4c
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C18)
  MOD_RES (19)..(20): Aib
  C-term amide
HXQGTFTSDYSKYLDERKXX

SEQ ID NO: 603 - protein, 20 aa, Artificial Sequence
  Description of Artificial Sequence: Synthetic peptide
  MOD_RES (2)..(2): Ac4c
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (18)..(18): Lys(C20)
  MOD_RES (19)..(20): Aib
  C-term amide
HXQGTFTSDYSKYLDERKXX

SEQ ID NO: 604 - protein, 20 aa, Artificial Sequence
  Description of Artificial Sequence: Synthetic peptide
  MOD_RES (2)..(2): Ac4c
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (17)..(17): hArg
  MOD_RES (18)..(18): Lys(C12)
  MOD_RES (19)..(20): Aib
  C-term amide
HXQGTFTSDYSKYLDERKXX

SEQ ID NO: 605 - protein, 20 aa, Artificial Sequence
  Description of Artificial Sequence: Synthetic peptide
  MOD_RES (2)..(2): Ac4c
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (17)..(17): hArg
  MOD_RES (18)..(18): Lys(C14)
  MOD_RES (19)..(20): Aib
  C-term amide
HXQGTFTSDYSKYLDERKXX

SEQ ID NO: 606 - protein, 20 aa, Artificial Sequence
  Description of Artificial Sequence: Synthetic peptide
  MOD_RES (2)..(2): Ac4c
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (17)..(17): hArg
  MOD_RES (18)..(18): Lys(C16)
  MOD_RES (19)..(20): Aib
  C-term amide
HXQGTFTSDYSKYLDERKXX

SEQ ID NO: 607 - protein, 20 aa, Artificial Sequence
  Description of Artificial Sequence: Synthetic peptide
  MOD_RES (2)..(2): Ac4c
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (17)..(17): hArg
  MOD_RES (18)..(18): Lys(C18)
  MOD_RES (19)..(20): Aib
  C-term amide
HXQGTFTSDYSKYLDERKXX

SEQ ID NO: 608 - protein, 20 aa, Artificial Sequence
  Description of Artificial Sequence: Synthetic peptide
  MOD_RES (2)..(2): Ac4c
  MOD_RES (12)..(12): Lys is cyclized through side chain to form a lactam linkage
  misc_feature (16)..(20): Cyclic
  MOD_RES (16)..(16): Glu is cyclized through side chain to form a lactam linkage
  MOD_RES (17)..(17): hArg
  MOD_RES (18)..(18): Lys(C20)
  MOD_RES (19)..(20): Aib
  C-term amide
HXQGTFTSDYSKYLDERKXX

SEQ ID NO: 609 - protein, 20 aa, Artificial Sequence
  Description of Artificial Sequence: Synthetic peptide
  MOD_RES (2)..(2): Ac4c
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Lys(C12)
  MOD_RES (19)..(20): Aib
  C-term amide
HXQGTFTSDYSEYLDKRKXX

SEQ ID NO: 610 - protein, 20 aa, Artificial Sequence
  Description of Artificial Sequence: Synthetic peptide
  MOD_RES (2)..(2): Ac4c
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Lys(C14)
  MOD_RES (19)..(20): Aib
  C-term amide
HXQGTFTSDYSEYLDKRKXX

SEQ ID NO: 611 - protein, 20 aa, Artificial Sequence
  Description of Artificial Sequence: Synthetic peptide
  MOD_RES (2)..(2): Ac4c
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Lys(C16)
  MOD_RES (19)..(20): Aib
  C-term amide
HXQGTFTSDYSEYLDKRKXX

SEQ ID NO: 612 - protein, 20 aa, Artificial Sequence
  Description of Artificial Sequence: Synthetic peptide
  MOD_RES (2)..(2): Ac4c
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Lys(C18)
  MOD_RES (19)..(20): Aib
  C-term amide
HXQGTFTSDYSEYLDKRKXX

SEQ ID NO: 613 - protein, 20 aa, Artificial Sequence
  Description of Artificial Sequence: Synthetic peptide
  MOD_RES (2)..(2): Ac4c
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (18)..(18): Lys(C20)
  MOD_RES (19)..(20): Aib
  C-term amide
HXQGTFTSDYSEYLDKRKXX

SEQ ID NO: 614 - protein, 20 aa, Artificial Sequence
  Description of Artificial Sequence: Synthetic peptide
  MOD_RES (2)..(2): Ac4c
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): hArg
  MOD_RES (18)..(18): Lys(C12)
  MOD_RES (19)..(20): Aib
  C-term amide
HXQGTFTSDYSEYLDKRKXX

SEQ ID NO: 615 - protein, 20 aa, Artificial Sequence
  Description of Artificial Sequence: Synthetic peptide
  MOD_RES (2)..(2): Ac4c
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): hArg
  MOD_RES (18)..(18): Lys(C14)
  MOD_RES (19)..(20): Aib
  C-term amide
HXQGTFTSDYSEYLDKRKXX

SEQ ID NO: 616 - protein, 20 aa, Artificial Sequence
  Description of Artificial Sequence: Synthetic peptide
  MOD_RES (2)..(2): Ac4c
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): hArg
  MOD_RES (18)..(18): Lys(C16)
  MOD_RES (19)..(20): Aib
  C-term amide
HXQGTFTSDYSEYLDKRKXX

SEQ ID NO: 617 - protein, 20 aa, Artificial Sequence
  Description of Artificial Sequence: Synthetic peptide
  MOD_RES (2)..(2): Ac4c
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): hArg
  MOD_RES (18)..(18): Lys(C18)
  MOD_RES (19)..(20): Aib
  C-term amide
HXQGTFTSDYSEYLDKRKXX

SEQ ID NO: 618 - protein, 20 aa, Artificial Sequence
  Description of Artificial Sequence: Synthetic peptide
  MOD_RES (2)..(2): Ac4c
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): hArg
  MOD_RES (18)..(18): Lys(C20)
  MOD_RES (19)..(20): Aib
  C-term amide
HXQGTFTSDYSEYLDKRKXX

SEQ ID NO: 619 - protein, 19 aa, Artificial Sequence
  Description of Artificial Sequence: Synthetic peptide
  MOD_RES (2)..(2): Aib or Ac4c
  MOD_RES (16)..(16): Aib
  MOD_RES (17)..(17): Arg, hArg or Gln
  MOD_RES (18)..(18): Lys(N-omega-1'-alkyl beta-D-glucuronyl)
  MOD_RES (19)..(19): Aib, Ac4c or Ac5c
  C-term NH2
  see specification as filed for detailed description of substitutions and preferred embodiments
HXQGTFTSDYSKYLDXXKX

SEQ ID NO: 620 - protein, 20 aa, Artificial Sequence
  Description of Artificial Sequence: Synthetic peptide
  MOD_RES (2)..(2): Aib or Ac4c
  MOD_RES (16)..(16): Aib
  MOD_RES (17)..(17): Arg, hArg or Gln
  MOD_RES (18)..(18): Lys(N-omega-1'-alkyl beta-D-glucuronyl)
  MOD_RES (19)..(20): Aib, Ac4c or Ac5c
  C-term NH2
  see specification as filed for detailed description of substitutions and preferred embodiments
HXQGTFTSDYSKYLDXXKXX

SEQ ID NO: 621 - protein, 19 aa, Artificial Sequence
  Description of Artificial Sequence: Synthetic peptide
  MOD_RES (2)..(2): Aib or Ac4c
  MOD_RES (16)..(16): Aib or Ac4c
  MOD_RES (17)..(17): Arg, hArg or Gln
  MOD_RES (18)..(18): Lys(N-omega-1'-alkyl beta-D-glucuronyl)
  MOD_RES (19)..(19): Aib, Ac4c or Ac5c
  C-term NH2
  see specification as filed for detailed description of substitutions and preferred embodiments
HXQGTFTSDYSKYLDXXKX

SEQ ID NO: 622 - protein, 29 aa, Artificial Sequence
  Description of Artificial Sequence: Synthetic peptide
  MOD_RES (2)..(2): Aib or Ac4c
  misc_feature (16)..(20): Cyclic
  MOD_RES (16)..(16): Lys or Glu and are cyclized through their side chains to form a lactam linkage
  MOD_RES (17)..(17): Arg, hArg or Gln
  MOD_RES (20)..(20): Lys or Glu and are cyclized through their side chains to form a lactam linkage
  MOD_RES (24)..(24): Lys(N-omega-1'-alkyl beta-D-glucuronyl)
  MOD_RES (27)..(27): Met or Nle
  C-term NH2
  see specification as filed for detailed description of substitutions and preferred embodiments
HXQGTFTSDYSKYLDXXAAXEFIKWLXNT

SEQ ID NO: 623 - protein, 29 aa, Artificial Sequence
  Description of Artificial Sequence: Synthetic peptide
  MOD_RES (2)..(2): Aib or Ac4c
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(N-omega-1'-alkyl beta-D-glucuronyl)
  MOD_RES (29)..(29): Thr, Aib, Ac4c or Ac5c
  C-term NH2
  see specification as filed for detailed description of substitutions and preferred embodiments
HXQGTFTSDYSKYLDEQAAKEFIKWLMNX

SEQ ID NO: 624 - protein, 20 aa, Artificial Sequence
  Description of Artificial Sequence: Synthetic peptide
  MOD_RES (2)..(2): Aib or Ac4c
  misc_feature (12)..(16): Cyclic
  MOD_RES (12)..(12): Lys or Glu and are cyclized through their side chains to form a lactam linkage
  MOD_RES (16)..(16): Lys or Glu and are cyclized through their side chains to form a lactam linkage
  MOD_RES (17)..(17): Arg or hArg
  MOD_RES (18)..(18): Lys(N-omega-1'-alkyl beta-D-glucuronyl)
  MOD_RES (19)..(20): Aib, Ac4c or Ac5c
  C-term NH2
  see specification as filed for detailed description of substitutions and preferred embodiments
HXQGTFTSDYSXYLDXXKXX

SEQ ID NO: 625 - protein, 20 aa, Artificial Sequence
  Description of Artificial Sequence: Synthetic peptide
  MOD_RES (2)..(2): Ac4c
  misc_feature (12)..(16): Cyclic
  MOD_RES (12)..(12): Glu is cyclized through side chain to form a lactam linkage
  MOD_RES (16)..(16): Lys is cyclized through side chain to form a lactam linkage
  MOD_RES (17)..(17): Arg or hArg
  MOD_RES (18)..(18): Lys(N-omega-1'-alkyl beta-D-glucuronyl)
  MOD_RES (19)..(20): Aib
  C-term NH2
  see specification as filed for detailed description of substitutions and preferred embodiments
HXQGTFTSDYSEYLDKXKXX

SEQ ID NO: 626 - protein, 20 aa, Artificial Sequence
  Description of Artificial Sequence: Synthetic peptide
  MOD_RES (2)..(2): Ser, Ala, Gly, Aib, Ac4c or Ac5c
  misc_feature (12)..(16): Cyclic
  MOD_RES (12)..(12): Lys or Glu and are cyclized through their side chains to form a lactam linkage
  MOD_RES (16)..(16): Lys or Glu and are cyclized through their side chains to form a lactam linkage
  MOD_RES (17)..(17): Arg or hArg
  MOD_RES (18)..(18): Lys(N-omega-1'-alkyl beta-D-glucuronyl)
  MOD_RES (19)..(20): Aib, Ac4c or Ac5c
  C-term NH2
  see specification as filed for detailed description of substitutions and preferred embodiments
HXQGTFTSDYSXYLDXXKXX

SEQ ID NO: 627 - protein, 19 aa, Artificial Sequence
  Description of Artificial Sequence: Synthetic peptide
  MOD_RES (2)..(2): Aib or Ac4c
  MOD_RES (6)..(6): Me2Phe, MePhe or Phe
  MOD_RES (17)..(17): Aib
  MOD_RES (18)..(18): Lys(N-omega-1'-dodecyl beta-D-glucuronyl)
  MOD_RES (19)..(19): Aib, Ac4c or Ac5c
  C-term NH2
  see specification as filed for detailed description of substitutions and preferred embodiments
HXQGTXTSDYSKYLDSXKX

SEQ ID NO: 628 - protein, 20 aa, Artificial Sequence
  Description of Artificial Sequence: Synthetic peptide
  MOD_RES (2)..(2): Aib or Ac4c
  MOD_RES (6)..(6): Me2Phe, MePhe or Phe
  MOD_RES (17)..(17): Arg or hArg
  MOD_RES (18)..(18): Lys(N-omega-1'-dodecyl beta-D-glucuronyl)
  MOD_RES (19)..(20): Aib, Ac4c or Ac5c
  C-term NH2
  see specification as filed for detailed description of substitutions and preferred embodiments
HXQGTXTSDYSKYLDSXKXX

SEQ ID NO: 629 - protein, 23 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (21)..(21): Lys(N-omega-1'-alkyl beta-D-glucuronyl)
  MOD_RES (23)..(23): Aib, Ac4c or Ac5c
  C-term NH2
  see specification as filed for detailed description of substitutions and preferred embodiments
HXQGTFTSDYSKYLDERAAKKFX

SEQ ID NO: 630 - protein, 23 aa, Artificial Sequence
  Description of Artificial Sequence: Synthetic peptide
  MOD_RES (2)..(2): Aib or Ac4c
  MOD_RES (6)..(6): Me2Phe, MePhe or Phe
  MOD_RES (12)..(12): Lys, Glu, Ser or U(X); wherein "U(X)" is a natural or unnatural amino acid comprising a functional group covalently attached to the surfactant X
  misc_feature (16)..(20): Cyclic
  MOD_RES (16)..(16): Absent or Ser, Gly, Glu, Aib, Ac5c, Lys, Arg or U(X); wherein "U(X)" is a natural or unnatural amino acid comprising a functional group covalently attached to the surfactant X
  MOD_RES (17)..(17): Arg, hArg or Gln
  MOD_RES (18)..(18): Aib or Ala
  MOD_RES (20)..(20): Absent or Gln, Lys, Arg, Cit, Glu, Aib, Ac4c, Ac5c or U(X); wherein "U(X)" is a natural or unnatural amino acid comprising a functional group covalently attached to the surfactant X
  MOD_RES (21)..(21): Lys(N-omega-1'-alkyl beta-D-glucuronyl)
  MOD_RES (23)..(23): Aib, Ac4c or Ac5c
  C-term NH2
  see specification as filed for detailed description of substitutions and preferred embodiments
HXQGTXTSDYSXYLDXXXAXKFX

SEQ ID NO: 631 - protein, 20 aa, Artificial Sequence
  Description of Artificial Sequence: Synthetic peptide
  MOD_RES (2)..(2): Aib or Ac4c
  misc_feature (12)..(16): Cyclic
  MOD_RES (12)..(12): Lys or Glu and are cyclized through their side chains to form a lactam linkage
  MOD_RES (16)..(16): Lys or Glu and are cyclized through their side chains to form a lactam linkage
  MOD_RES (17)..(17): Arg or hArg
  MOD_RES (18)..(18): Lys(N-omega-1'-alkyl beta-D-glucuronyl)
  MOD_RES (19)..(20): Aib, Ac4c or Ac5c
  C-term NH2
  see specification as filed for detailed description of substitutions and preferred embodiments
HXQGTFTSDYSXYLDXXKXX

SEQ ID NO: 632 - protein, 29 aa, Unknown
  Description of Unknown: Glucagon peptide
HSQGTFTSDYSKYLDSRRAQDFVQWLMNT

SEQ ID NO: 633 - protein, 37 aa, Unknown
  Description of Unknown: Oxyntomodulin peptide
HSQGTFTSDYSKYLDSRRAQDFVQWLMNTKRNRNNIA

SEQ ID NO: 634 - protein, 30 aa, Unknown
  Description of Unknown: Glucagon-like peptide 1
HAEGTFTSDVSSYLEGQAAKEFIAWLVKGR

SEQ ID NO: 635 - protein, 38 aa, Artificial Sequence; identical to SEQ ID NO: 303
  Description of Artificial Sequence: Synthetic polypeptide
  MOD_RES (1)..(1): pGlu or absent
  MOD_RES (2)..(2): His, N-Ac-His, or N-R3-His
  MOD_RES (3)..(3): Ser, Ala, Gly, Aib, Ac4c or Ac5c
  MOD_RES (4)..(4): Gln or Cit
  MOD_RES (5)..(5): Gly or D-Ala
  MOD_RES (6)..(6): Thr or Ser
  MOD_RES (7)..(7): Phe, Trp, F2Phe, Me2Phe or Nal(2)
  MOD_RES (8)..(8): Thr or Ser
  MOD_RES (9)..(9): Ser or Asp
  MOD_RES (10)..(10): Asp or Glu
  MOD_RES (11)..(11): Tyr, Leu, Met, Nal(2), Bip or Bip2EtMeO
  MOD_RES (12)..(12): Ser, Asn or U(X); wherein "U" is any linking amino acid and "X" is a surfactant-linked to the side chain of "U"
  MOD_RES (13)..(13): Lys, Glu, Ser, Arg or U(X); wherein "U" is any linking amino acid and "X" is a surfactant-linked to the side chain of "U"
  MOD_RES (14)..(14): Absent or Tyr, Gln, Cit or U(X); wherein "U" is any linking amino acid and "X" is a surfactant-linked to the side chain of "U"
  MOD_RES (15)..(15): Absent or Leu, Met, Nle or U(X); wherein "U" is any linking amino acid and "X" is a surfactant-linked to the side chain of "U"
  MOD_RES (16)..(16): Absent or Asp, Glu or U(X); wherein "U" is any linking amino acid and "X" is a surfactant-linked to the side chain of "U"
  MOD_RES (17)..(17): Absent or Ser, Gly, Glu, Aib, Ac5c, Lys, Arg or U(X); wherein "U" is any linking amino acid and "X" is a surfactant-linked to the side chain of "U"
  MOD_RES (18)..(18): Absent or Arg, hArg, Gln, Glu, Cit, Aib, Ac4c, Ac5c or U(X); wherein "U" is any linking amino acid and "X" is a surfactant-linked to the side chain of "U"
  MOD_RES (19)..(19): Absent or Arg, hArg, Ala, Aib, Ac4c, Ac5c or U(X); wherein "U" is any linking amino acid and "X" is a surfactant-linked to the side chain of "U"
  MOD_RES (20)..(20): Absent or Ala, Val, Aib, Ac4c,Ac5c or U(X); wherein "U" is any linking amino acid and "X" is a surfactant-linked to the side chain of "U"
  MOD_RES (21)..(21): Absent or Gln, Lys, Arg, Cit, Glu, Aib, Ac4c, Ac5c or U(X); wherein "U" is any linking amino acid and "X" is a surfactant-linked to the side chain of "U"
  MOD_RES (22)..(22): Absent or Asp, Glu, Leu, Aib, Ac4c, Ac5c or U(X); wherein "U" is any linking amino acid and "X" is a surfactant-linked to the side chain of "U"
  MOD_RES (23)..(23): Absent or Phe, Trp, Nal(2), Aib, Ac4c, Ac5c or U(X); wherein "U" is any linking amino acid and "X" is a surfactant-linked to the side chain of "U"
  MOD_RES (24)..(24): Absent or Val, Ile, Aib, Ac4c, Ac5c or U(X); wherein "U" is any linking amino acid and "X" is a surfactant-linked to the side chain of "U"
  MOD_RES (25)..(25): Absent or Gln, Ala, Glu, Cit or U(X); wherein "U" is any linking amino acid and "X" is a surfactant-linked to the side chain of "U"
  MOD_RES (26)..(26): Absent or Trp, Nal(2) or U(X); wherein "U" is any linking amino acid and "X" is a surfactant-linked to the side chain of "U"
  MOD_RES (27)..(27): Absent or Leu, U(X); wherein "U" is any linking amino acid and "X" is a surfactant-linked to the side chain of "U"
  MOD_RES (28)..(28): Absent or Met, Val, Nle, Lys or U(X); wherein "U" is any linking amino acid and "X" is a surfactant- linked to the side chain of "U"
  MOD_RES (29)..(29): Absent or Asn, Lys or U(X); wherein "U" is any linking amino acid and "X" is a surfactant-linked to the side chain of "U"
  MOD_RES (30)..(30): Absent or Thr, Gly, Aib, Ac4c, Ac5c or U(X); wherein "U" is any linking amino acid and "X" is a surfactant-linked to the side chain of "U"
  MOD_RES (31)..(31): Absent or Lys, Aib, Ac4c, Ac5c or U(X); wherein "U" is any linking amino acid and "X" is a surfactant-linked to the side chain of "U"
  MOD_RES (32)..(32): Absent or Arg, Aib, Ac4c, Ac5c or U(X); wherein "U" is any linking amino acid and "X" is a surfactant-linked to the side chain of "U"
  MOD_RES (33)..(33): Absent or Asn, Aib, Ac4c, Ac5c or U(X); wherein "U" is any linking amino acid and "X" is a surfactant-linked to the side chain of "U"
  MOD_RES (34)..(34): Absent or Arg, Aib, Ac5c or U(X); wherein "U" is any linking amino acid and "X" is a surfactant-linked to the side chain of "U"
  MOD_RES (35)..(35): Absent or Asn, Aib, Ac4c, Ac5c or U(X); wherein "U" is any linking amino acid and "X" is a surfactant-linked to the side chain of "U"
  MOD_RES (36)..(36): Absent or Asn, Aib, Ac4c, Ac5c or U(X); wherein "U" is any linking amino acid and "X" is a surfactant-linked to the side chain of "U"
  MOD_RES (37)..(37): Absent or Ile, Ala, Aib, Ac4c, Ac5C or U(X); wherein "U" is any linking amino acid and "X" is a surfactant-linked to the side chain of "U"
  MOD_RES (38)..(38): Absent or U(X); wherein U(X); wherein "U" is any linking amino acid and "X" is a surfactant-linked to the side chain of "U"
  C-term OH, or -NH-R3, wherein R3 is H or C1-C12 substituted or unsubstituted alklyl
  see specification as filed for detailed description of substitutions and preferred embodiments

SEQ ID NO: 636 - protein, 19 aa, Artificial Sequence
  Description of Artificial Sequence: Synthetic peptide
  MOD_RES (2)..(2): Aib
  MOD_RES (18)..(18): Lys(N-epsilon-dodecanoyl)
  MOD_RES (19)..(19): Aib
  C-term NH2
HXQGTFTSDYSKYLDSRKX

SEQ ID NO: 637 - protein, 19 aa, Artificial Sequence
  Description of Artificial Sequence: Synthetic peptide
  MOD_RES (2)..(2): Aib
  MOD_RES (18)..(18): Lys(N-epsilon-tetradecanoyl)
  MOD_RES (19)..(19): Ac4c
  C-term NH2
HXQGTFTSDYSKYLDSRKX

SEQ ID NO: 638 - protein, 19 aa, Artificial Sequence
  Description of Artificial Sequence: Synthetic peptide
  MOD_RES (2)..(2): Aib
  MOD_RES (18)..(18): Lys(N-epsilon-hexadecanoyl)
  MOD_RES (19)..(19): Aib
  C-term NH2
HXQGTFTSDYSKYLDSRKX

SEQ ID NO: 639 - protein, 18 aa, Artificial Sequence
  Description of Artificial Sequence: Synthetic peptide
  MOD_RES (2)..(2): Aib
  MOD_RES (16)..(16): Aib
  MOD_RES (18)..(18): Lys(N-epsilon-dodecanoyl)
  C-term NH2
HXQGTFTSDYSKYLDXRK

SEQ ID NO: 640 - protein, 18 aa, Artificial Sequence
  Description of Artificial Sequence: Synthetic peptide
  MOD_RES (2)..(2): Aib
  MOD_RES (16)..(16): Aib
  MOD_RES (18)..(18): Lys(N-epsilon-tetradecanoyl)
  C-term NH2
HXQGTFTSDYSKYLDXRK

SEQ ID NO: 641 - protein, 18 aa, Artificial Sequence
  Description of Artificial Sequence: Synthetic peptide
  MOD_RES (2)..(2): Aib
  MOD_RES (16)..(16): Aib
  MOD_RES (18)..(18): Lys(N-epsilon-hexadecanoyl)
  C-term NH2
HXQGTFTSDYSKYLDXRK

SEQ ID NO: 642 - protein, 19 aa, Artificial Sequence
  Description of Artificial Sequence: Synthetic peptide
  MOD_RES (2)..(2): Aib
  MOD_RES (18)..(18): Lys(N-epsilon-(gamma-glutamyl)-N-alpha-tetradecanoyl))
  MOD_RES (19)..(19): Aib
  C-term NH2
HXQGTFTSDYSKYLDSRKX

SEQ ID NO: 643 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(18): Cys(S-(3-(PEG4-aminoethylacetamide-Cholesterol)))
  MOD_RES (19)..(19): Aib
  C-term NH2
HXQGTFTSDYSKYLDXRCX

SEQ ID NO: 644 - protein, 18 aa, Artificial Sequence
  Description of Artificial Sequence: Synthetic peptide
  MOD_RES (2)..(2): Aib
  misc_feature (12)..(16): Cyclic
  MOD_RES (18)..(18): Cys(S-(3-(PEG4-aminoethylacetamide-Cholesterol)))
  C-term NH2
HXQGTFTSDYSEYLDKRC

SEQ ID NO: 645 - protein, 4 aa, Artificial Sequence
  Description of Artificial Sequence: Synthetic peptide
  MOD_RES (1)..(1): Dmt
  MOD_RES (2)..(2): Tic
  MOD_RES (4)..(4): Lys(C14-glucuronyl)
  C-term NH2
YXFK

SEQ ID NO: 646 - protein, 20 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C12)
  MOD_RES (19)..(19): Aib
  MOD_RES (20)..(20): Aib
  C-term amide
HXQGTFTSDYSKYLDXRKXX

SEQ ID NO: 647 - protein, 20 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C14)
  MOD_RES (19)..(19): Aib
  MOD_RES (20)..(20): Aib
  C-term amide
HXQGTFTSDYSKYLDXRKXX

SEQ ID NO: 648 - protein, 20 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C16)
  MOD_RES (19)..(19): Aib
  MOD_RES (20)..(20): Aib
  C-term amide
HXQGTFTSDYSKYLDXRKXX

SEQ ID NO: 649 - protein, 20 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C18)
  MOD_RES (19)..(19): Aib
  MOD_RES (20)..(20): Aib
  C-term amide
HXQGTFTSDYSKYLDXRKXX

SEQ ID NO: 650 - protein, 20 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C20)
  MOD_RES (19)..(19): Aib
  MOD_RES (20)..(20): Aib
  C-term amide
HXQGTFTSDYSKYLDXRKXX

SEQ ID NO: 651 - protein, 20 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Lys(C12)
  MOD_RES (19)..(19): Aib
  MOD_RES (20)..(20): Aib
  C-term amide
HXQGTFTSDYSKYLDXRKXX

SEQ ID NO: 652 - protein, 20 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Lys(C14)
  MOD_RES (19)..(19): Aib
  MOD_RES (20)..(20): Aib
  C-term amide
HXQGTFTSDYSKYLDXRKXX

SEQ ID NO: 653 - protein, 20 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Lys(C16)
  MOD_RES (19)..(19): Aib
  MOD_RES (20)..(20): Aib
  C-term amide
HXQGTFTSDYSKYLDXRKXX

SEQ ID NO: 654 - protein, 20 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Lys(C18)
  MOD_RES (19)..(19): Aib
  MOD_RES (20)..(20): Aib
  C-term amide
HXQGTFTSDYSKYLDXRKXX

SEQ ID NO: 655 - protein, 20 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Lys(C20)
  MOD_RES (19)..(19): Aib
  MOD_RES (20)..(20): Aib
  C-term amide
HXQGTFTSDYSKYLDXRKXX

SEQ ID NO: 656 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C12)
  MOD_RES (19)..(19): Aib
  C-term amide
HXQGTFTSDYSKYLDXRKX

SEQ ID NO: 657 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C14)
  MOD_RES (19)..(19): Aib
  C-term amide
HXQGTFTSDYSKYLDXRKX

SEQ ID NO: 658 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C16)
  MOD_RES (19)..(19): Aib
  C-term amide
HXQGTFTSDYSKYLDXRKX

SEQ ID NO: 659 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C18)
  MOD_RES (19)..(19): Aib
  C-term amide
HXQGTFTSDYSKYLDXRKX

SEQ ID NO: 660 - protein, 19 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C20)
  MOD_RES (19)..(19): Aib
  C-term amide
HXQGTFTSDYSKYLDXRKX

SEQ ID NO: 661 - protein, 19 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Lys(C12)
  MOD_RES (19)..(19): Aib
  C-term amide
HXQGTFTSDYSKYLDXRKX

SEQ ID NO: 662 - protein, 19 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Lys(C14)
  MOD_RES (19)..(19): Aib
  C-term amide
HXQGTFTSDYSKYLDXRKX

SEQ ID NO: 663 - protein, 19 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Lys(C16)
  MOD_RES (19)..(19): Aib
  C-term amide
HXQGTFTSDYSKYLDXRKX

SEQ ID NO: 664 - protein, 19 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Lys(C18)
  MOD_RES (19)..(19): Aib
  C-term amide
HXQGTFTSDYSKYLDXRKX

SEQ ID NO: 665 - protein, 19 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Lys(C20)
  MOD_RES (19)..(19): Aib
  C-term amide
HXQGTFTSDYSKYLDXRKX

SEQ ID NO: 666 - protein, 19 aa, Artificial Sequence
  Description of Artificial Sequence: Synthetic peptide
  MOD_RES (2)..(2): Ac3c
  MOD_RES (16)..(16): Aib
  MOD_RES (17)..(17): hArg
  MOD_RES (18)..(18): Lys(C12)
  MOD_RES (19)..(19): Aib
  C-term amide
HXQGTFTSDYSKYLDXRKX

SEQ ID NO: 667 - protein, 18 aa, Artificial Sequence
  Description of Artificial Sequence: Synthetic peptide
  MOD_RES (2)..(2): Aib
  MOD_RES (18)..(18): Lys(C12)
  C-term amide
HXQGTFTSDYSKYLDSRK

SEQ ID NO: 668 - protein, 18 aa, Artificial Sequence
  Description of Artificial Sequence: Synthetic peptide
  MOD_RES (2)..(2): Aib
  MOD_RES (17)..(17): hArg
  MOD_RES (18)..(18): Lys(C12)
  C-term amide
HXQGTFTSDYSKYLDSRK

SEQ ID NO: 669 - protein, 18 aa, Artificial Sequence
  Description of Artificial Sequence: Synthetic peptide
  MOD_RES (2)..(2): Aib
  MOD_RES (16)..(16): Aib
  MOD_RES (18)..(18): Lys(C12)
  C-term amide
HXQGTFTSDYSKYLDXRK

SEQ ID NO: 670 - protein, 18 aa, Artificial Sequence
  Description of Artificial Sequence: Synthetic peptide
  MOD_RES (2)..(2): Aib
  MOD_RES (16)..(16): Aib
  MOD_RES (17)..(17): hArg
  MOD_RES (18)..(18): Lys(C12)
  C-term amide
HXQGTFTSDYSKYLDXRK

SEQ ID NO: 671 - protein, 18 aa, Artificial Sequence
  Description of Artificial Sequence: Synthetic peptide
  MOD_RES (2)..(2): Ac4c
  MOD_RES (16)..(16): Aib
  MOD_RES (18)..(18): Lys(C12)
  C-term amide
HXQGTFTSDYSKYLDXRK

SEQ ID NO: 672 - protein, 19 aa, Artificial Sequence
  Description of Artificial Sequence: Synthetic peptide
  MOD_RES (2)..(2): Ac4c
  MOD_RES (16)..(16): Aib
  MOD_RES (18)..(18): Lys(C12)
  MOD_RES (19)..(19): Aib
  C-term amide
HXQGTFTSDYSKYLDXRKX

SEQ ID NO: 673 - protein, 18 aa, Artificial Sequence
  Description of Artificial Sequence: Synthetic peptide
  MOD_RES (2)..(2): Ac4c
  MOD_RES (16)..(16): Aib
  MOD_RES (17)..(17): hArg
  MOD_RES (18)..(18): Lys(C12)
  C-term amide
HXQGTFTSDYSKYLDXRK

SEQ ID NO: 674 - protein, 18 aa, Artificial Sequence
  Description of Artificial Sequence: Synthetic peptide
  MOD_RES (2)..(2): Ac4c
  MOD_RES (16)..(16): Aib
  MOD_RES (17)..(17): hArg
  MOD_RES (18)..(18): Lys(C14)
  C-term amide
HXQGTFTSDYSKYLDXRK

SEQ ID NO: 675 - protein, 18 aa, Artificial Sequence
  Description of Artificial Sequence: Synthetic peptide
  MOD_RES (2)..(2): Ac4c
  MOD_RES (16)..(16): Aib
  MOD_RES (17)..(17): hArg
  MOD_RES (18)..(18): Lys(C16)
  C-term amide
HXQGTFTSDYSKYLDXRK

SEQ ID NO: 676 - protein, 18 aa, Artificial Sequence
  Description of Artificial Sequence: Synthetic peptide
  MOD_RES (2)..(2): Ac4c
  MOD_RES (16)..(16): Aib
  MOD_RES (17)..(17): hArg
  MOD_RES (18)..(18): Lys(C18)
  C-term amide
HXQGTFTSDYSKYLDXRK

SEQ ID NO: 677 - protein, 18 aa, Artificial Sequence
  Description of Artificial Sequence: Synthetic peptide
  MOD_RES (2)..(2): Aib
  misc_feature (10)..(14): Cyclic
  MOD_RES (10)..(10): Glu is cyclized through side chain to form a lactam linkage
  MOD_RES (14)..(14): Lys is cyclized through side chain to form a lactam linkage
  MOD_RES (18)..(18): Lys(C12)
  C-term amide
HXQGTFTSDESKYKDSRK

SEQ ID NO: 678 - protein, 18 aa, Artificial Sequence
  Description of Artificial Sequence: Synthetic peptide
  MOD_RES (2)..(2): Ac4c
  misc_feature (10)..(14): Cyclic
  MOD_RES (10)..(10): Glu is cyclized through side chain to form a lactam linkage
  MOD_RES (14)..(14): Lys is cyclized through side chain to form a lactam linkage
  MOD_RES (16)..(16): Aib
  MOD_RES (17)..(17): hArg
  MOD_RES (18)..(18): Lys(C14)
  C-term amide
HXQGTFTSDESKYKDXRK

SEQ ID NO: 679 - protein, 18 aa, Artificial Sequence
  Description of Artificial Sequence: Synthetic peptide
  MOD_RES (2)..(2): Aib
  misc_feature (13)..(17): Cyclic
  MOD_RES (13)..(13): Glu is cyclized through side chain to form a lactam linkage
  MOD_RES (17)..(17): Lys is cyclized through side chain to form a lactam linkage
  MOD_RES (18)..(18): Lys(C12)
  C-term amide
HXQGTFTSDYSKELDSKK

SEQ ID NO: 680 - protein, 20 aa, Artificial Sequence
  Description of Artificial Sequence: Synthetic peptide
  MOD_RES (2)..(2): Aib
  misc_feature (17)..(20): Cyclic
  MOD_RES (17)..(17): Glu is cyclized through side chain to form a lactam linkage
  MOD_RES (18)..(18): Lys(C12)
  MOD_RES (20)..(20): Lys is cyclized through side chain to form a lactam linkage
  C-term amide
HXQGTFTSDYSKYLDSEKAK

SEQ ID NO: 681 - protein, 21 aa, Artificial Sequence
  Description of Artificial Sequence: Synthetic peptide
  MOD_RES (2)..(2): Aib
  misc_feature (17)..(21): Cyclic
  MOD_RES (17)..(17): Glu is cyclized through side chain to form a lactam linkage
  MOD_RES (18)..(18): Lys(C12)
  MOD_RES (21)..(21): Lys is cyclized through side chain to form a lactam linkage
  C-term amide
HXQGTFTSDYSKYLDSEKARK

SEQ ID NO: 682 - protein, 21 aa, Artificial Sequence
  Description of Artificial Sequence: Synthetic peptide
  MOD_RES (2)..(2): Aib
  misc_feature (17)..(21): Cyclic
  MOD_RES (17)..(17): Glu is cyclized through side chain to form a lactam linkage
  MOD_RES (18)..(18): Lys(C14)
  MOD_RES (21)..(21): Lys is cyclized through side chain to form a lactam linkage
  C-term amide
HXQGTFTSDYSKYLDSEKARK

SEQ ID NO: 683 - protein, 21 aa, Artificial Sequence
  Description of Artificial Sequence: Synthetic peptide
  MOD_RES (2)..(2): Aib
  misc_feature (17)..(21): Cyclic
  MOD_RES (17)..(17): Glu is cyclized through side chain to form a lactam linkage
  MOD_RES (18)..(18): Lys(C16)
  MOD_RES (21)..(21): Lys is cyclized through side chain to form a lactam linkage
  C-term amide
HXQGTFTSDYSKYLDSEKARK

SEQ ID NO: 684 - protein, 21 aa, Artificial Sequence
  Description of Artificial Sequence: Synthetic peptide
  MOD_RES (2)..(2): Aib
  misc_feature (17)..(21): Cyclic
  MOD_RES (17)..(17): Glu is cyclized through side chain to form a lactam linkage
  MOD_RES (18)..(18): Lys(C18)
  MOD_RES (21)..(21): Lys is cyclized through side chain to form a lactam linkage
  C-term amide
HXQGTFTSDYSKYLDSEKARK

SEQ ID NO: 685 - protein, 21 aa, Artificial Sequence
  Description of Artificial Sequence: Synthetic peptide
  MOD_RES (2)..(2): Aib
  misc_feature (17)..(21): Cyclic
  MOD_RES (17)..(17): Glu is cyclized through side chain to form a lactam linkage
  MOD_RES (18)..(18): Lys(C20)
  MOD_RES (21)..(21): Lys is cyclized through side chain to form a lactam linkage
  C-term amide
HXQGTFTSDYSKYLDSEKARK

SEQ ID NO: 686 - protein, 21 aa, Artificial Sequence
  Description of Artificial Sequence: Synthetic peptide
  MOD_RES (2)..(2): Aib
  misc_feature (17)..(21): Cyclic
  MOD_RES (17)..(17): Glu is cyclized through side chain to form a lactam linkage
  MOD_RES (18)..(18): Lys(C12)
  MOD_RES (21)..(21): Lys is cyclized through side chain to form a lactam linkage
  C-term amide
HXQGTFTSDYSKYLDSEKAQK

SEQ ID NO: 687 - protein, 21 aa, Artificial Sequence
  Description of Artificial Sequence: Synthetic peptide
  MOD_RES (2)..(2): Aib
  misc_feature (17)..(21): Cyclic
  MOD_RES (17)..(17): Glu is cyclized through side chain to form a lactam linkage
  MOD_RES (18)..(18): Lys(C14)
  MOD_RES (21)..(21): Lys is cyclized through side chain to form a lactam linkage
  C-term amide
HXQGTFTSDYSKYLDSEKAQK

SEQ ID NO: 688 - protein, 21 aa, Artificial Sequence
  Description of Artificial Sequence: Synthetic peptide
  MOD_RES (2)..(2): Aib
  misc_feature (17)..(21): Cyclic
  MOD_RES (17)..(17): Glu is cyclized through side chain to form a lactam linkage
  MOD_RES (18)..(18): Lys(C16)
  MOD_RES (21)..(21): Lys is cyclized through side chain to form a lactam linkage
  C-term amide
HXQGTFTSDYSKYLDSEKAQK

SEQ ID NO: 689 - protein, 21 aa, Artificial Sequence
  Description of Artificial Sequence: Synthetic peptide
  MOD_RES (2)..(2): Aib
  misc_feature (17)..(21): Cyclic
  MOD_RES (17)..(17): Glu is cyclized through side chain to form a lactam linkage
  MOD_RES (18)..(18): Lys(C18)
  MOD_RES (21)..(21): Lys is cyclized through side chain to form a lactam linkage
  C-term amide
HXQGTFTSDYSKYLDSEKAQK

SEQ ID NO: 690 - protein, 21 aa, Artificial Sequence
  Description of Artificial Sequence: Synthetic peptide
  MOD_RES (2)..(2): Aib
  misc_feature (17)..(21): Cyclic
  MOD_RES (17)..(17): Glu is cyclized through side chain to form a lactam linkage
  MOD_RES (18)..(18): Lys(C20)
  MOD_RES (21)..(21): Lys is cyclized through side chain to form a lactam linkage
  C-term amide
HXQGTFTSDYSKYLDSEKAQK

SEQ ID NO: 691 - protein, 21 aa, Artificial Sequence
  Description of Artificial Sequence: Synthetic peptide
  MOD_RES (2)..(2): Aib
  misc_feature (17)..(21): Cyclic
  MOD_RES (17)..(17): Glu is cyclized through side chain to form a lactam linkage
  MOD_RES (18)..(18): Lys(C12)
  MOD_RES (21)..(21): Lys is cyclized through side chain to form a lactam linkage
  C-term amide
HXQGTFTSDYSKYLDSEKVRK

SEQ ID NO: 692 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (11)..(11): Lys(C8)
  C-term amide
HXQGTFTSDYK

SEQ ID NO: 693 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (11)..(11): Lys(C14)
  C-term amide
HXQGTFTSDYK

SEQ ID NO: 694 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (11)..(11): Lys(C16)
  C-term amide
HXQGTFTSDYK

SEQ ID NO: 695 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (11)..(11): Lys(C20)
  C-term amide
HXQGTFTSDYK

SEQ ID NO: 696 - protein, 11 aa, Artificial Sequence
  Description of Artificial Sequence: Synthetic peptide
  MOD_RES (2)..(2): Aib
  MOD_RES (11)..(11): Lys(C12)
  C-term amide
HXQGTFTSDYK

SEQ ID NO: 697 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (11)..(11): Lys(C12)
  C-term amide
HXQGTFTSDYK

SEQ ID NO: 698 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (11)..(11): Lys(C18)
  C-term amide
HXQGTFTSDYK

SEQ ID NO: 699 - protein, 11 aa, Artificial Sequence
  Description of Artificial Sequence: Synthetic peptide
  MOD_RES (2)..(2): Alpha-MePro
  MOD_RES (11)..(11): Lys(C12)
  C-term amide
HPQGTFTSDYK

SEQ ID NO: 700 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (11)..(11): Lys(C12)
  C-term amide
HPQGTFTSDYK

SEQ ID NO: 701 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Lys(C12)
  C-term amide
HPQGTFTSDXK

SEQ ID NO: 702 - protein, 11 aa, Artificial Sequence
  Description of Artificial Sequence: Synthetic peptide
  MOD_RES (2)..(2): Aib
  MOD_RES (10)..(10): Bip
  MOD_RES (11)..(11): Lys(C12)
  C-term amide
HXQGTFTSDXK

SEQ ID NO: 703 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): Lys(C18)
  C-term amide
HXQGTFTSDXK

SEQ ID NO: 704 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (11)..(11): Lys(C8)
  C-term amide
HPQGTFTSDYK

SEQ ID NO: 705 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (11)..(11): Lys(16)
  C-term amide
HPQGTFTSDYK

SEQ ID NO: 706 - protein, 29 aa, Artificial Sequence
  Description of Artificial Sequence: Synthetic peptide
  MOD_RES (17)..(17): Lys(C8)
  C-term amide
HGQGTFTSDYSKYLDEKAAREFIAWLLNT

SEQ ID NO: 707 - protein, 29 aa, Artificial Sequence
  Description of Artificial Sequence: Synthetic peptide
  MOD_RES (17)..(17): Lys(C12)
  C-term amide
HGQGTFTSDYSKYLDEKAAREFIAWLLNT

SEQ ID NO: 708 - protein, 29 aa, Artificial Sequence
  Description of Artificial Sequence: Synthetic peptide
  MOD_RES (17)..(17): Lys(C14)
  C-term amide
HGQGTFTSDYSKYLDEKAAREFIAWLLNT

SEQ ID NO: 709 - protein, 29 aa, Artificial Sequence
  Description of Artificial Sequence: Synthetic peptide
  MOD_RES (17)..(17): Lys(C16)
  C-term amide
HGQGTFTSDYSKYLDEKAAREFIAWLLNT

SEQ ID NO: 710 - protein, 29 aa, Artificial Sequence
  Description of Artificial Sequence: Synthetic peptide
  MOD_RES (17)..(17): Lys(C18)
  C-term amide
HGQGTFTSDYSKYLDEKAAREFIAWLLNT

SEQ ID NO: 711 - protein, 29 aa, Artificial Sequence
  Description of Artificial Sequence: Synthetic peptide
  MOD_RES (17)..(17): Lys(C20)
  C-term amide
HGQGTFTSDYSKYLDEKAAREFIAWLLNT

SEQ ID NO: 712 - protein, 29 aa, Artificial Sequence
  Description of Artificial Sequence: Synthetic peptide
  MOD_RES (17)..(17): Lys(C8)
  C-term amide
HGQGTFTSDYSKYLDEKAAKEFIAWLLNT

SEQ ID NO: 713 - protein, 29 aa, Artificial Sequence
  Description of Artificial Sequence: Synthetic peptide
  MOD_RES (17)..(17): Lys(C14)
  C-term amide
HGQGTFTSDYSKYLDEKAAKEFIAWLLNT

SEQ ID NO: 714 - protein, 29 aa, Artificial Sequence
  Description of Artificial Sequence: Synthetic peptide
  MOD_RES (17)..(17): Lys(C16)
  C-term amide
HGQGTFTSDYSKYLDEKAAKEFIAWLLNT

SEQ ID NO: 715 - protein, 29 aa, Artificial Sequence
  Description of Artificial Sequence: Synthetic peptide
  MOD_RES (17)..(17): Lys(C20)
  C-term amide
HGQGTFTSDYSKYLDEKAAKEFIAWLLNT

SEQ ID NO: 716 - protein, 29 aa, Artificial Sequence
  Description of Artificial Sequence: Synthetic peptide
  C-term amide
HGQGTFTSDYSKYLDEKAAKEFIAWLLNT

SEQ ID NO: 717 - protein, 29 aa, Artificial Sequence
  Description of Artificial Sequence: Synthetic peptide
  MOD_RES (17)..(17): Lys(C12)
  C-term amide
HGQGTFTSDYSKYLDEKAAKEFIAWLLNT

SEQ ID NO: 718 - protein, 29 aa, Artificial Sequence
  Description of Artificial Sequence: Synthetic peptide
  MOD_RES (17)..(17): Lys(C18)
  C-term amide
HGQGTFTSDYSKYLDEKAAKEFIAWLLNT

SEQ ID NO: 719 - protein, 29 aa, Artificial Sequence
  Description of Artificial Sequence: Synthetic peptide
  MOD_RES (2)..(2): Aib
  MOD_RES (17)..(17): Lys(C18)
  C-term amide
HXQGTFTSDYSKYLDEKAAKEFIAWLLNT

SEQ ID NO: 720 - protein, 29 aa, Artificial Sequence
  Description of Artificial Sequence: Synthetic peptide
  C-term amide
HGQGTFTSDYSKYLDERRAKDFVQWLLNT

SEQ ID NO: 721 - protein, 29 aa, Artificial Sequence
  Description of Artificial Sequence: Synthetic peptide
  MOD_RES (20)..(20): Lys(C12)
  C-term amide
HGQGTFTSDYSKYLDERRAKDFVQWLLNT

SEQ ID NO: 722 - protein, 29 aa, Artificial Sequence
  Description of Artificial Sequence: Synthetic peptide
  MOD_RES (20)..(20): Lys(C18)
  C-term amide
HGQGTFTSDYSKYLDERRAKDFVQWLLNT

SEQ ID NO: 723 - protein, 29 aa, Artificial Sequence
  Description of Artificial Sequence: Synthetic peptide
  MOD_RES (2)..(2): Aib
  MOD_RES (20)..(20): Lys(C18)
  C-term amide
HXQGTFTSDYSKYLDERRAKDFVQWLLNT

SEQ ID NO: 724 - protein, 29 aa, Artificial Sequence
  Description of Artificial Sequence: Synthetic peptide
  MOD_RES (2)..(2): Aib
  MOD_RES (20)..(20): Lys(C8)
  C-term amide
HXQGTFTSDYSKYLDERRAKDFVQWLLNT

SEQ ID NO: 725 - protein, 29 aa, Artificial Sequence
  Description of Artificial Sequence: Synthetic peptide
  MOD_RES (2)..(2): Aib
  MOD_RES (20)..(20): Lys(C12)
  C-term amide
HXQGTFTSDYSKYLDERRAKDFVQWLLNT

SEQ ID NO: 726 - protein, 29 aa, Artificial Sequence
  Description of Artificial Sequence: Synthetic peptide
  MOD_RES (2)..(2): Aib
  MOD_RES (20)..(20): Lys(C14)
  C-term amide
HXQGTFTSDYSKYLDERRAKDFVQWLLNT

SEQ ID NO: 727 - protein, 29 aa, Artificial Sequence
  Description of Artificial Sequence: Synthetic peptide
  MOD_RES (2)..(2): Aib
  MOD_RES (20)..(20): Lys(C16)
  C-term amide
HXQGTFTSDYSKYLDERRAKDFVQWLLNT

SEQ ID NO: 728 - protein, 29 aa, Artificial Sequence
  Description of Artificial Sequence: Synthetic peptide
  MOD_RES (2)..(2): Aib
  MOD_RES (20)..(20): Lys(C18)
  C-term amide
HXQGTFTSDYSKYLDERRAKDFVQWLLNT

SEQ ID NO: 729 - protein, 29 aa, Artificial Sequence
  Description of Artificial Sequence: Synthetic peptide
  MOD_RES (2)..(2): Aib
  MOD_RES (20)..(20): Lys(C20)
  C-term amide
HXQGTFTSDYSKYLDERRAKDFVQWLLNT

SEQ ID NO: 730 - protein, 29 aa, Artificial Sequence
  Description of Artificial Sequence: Synthetic peptide
  MOD_RES (20)..(20): Lys(C8)
  C-term amide
HGQGTFTSDYSKYLDERRAKDFVQWLLNT

SEQ ID NO: 731 - protein, 29 aa, Artificial Sequence
  Description of Artificial Sequence: Synthetic peptide
  MOD_RES (20)..(20): Lys(C12)
  C-term amide
HGQGTFTSDYSKYLDERRAKDFVQWLLNT

SEQ ID NO: 732 - protein, 29 aa, Artificial Sequence
  Description of Artificial Sequence: Synthetic peptide
  MOD_RES (20)..(20): Lys(C14)
  C-term amide
HGQGTFTSDYSKYLDERRAKDFVQWLLNT

SEQ ID NO: 733 - protein, 29 aa, Artificial Sequence
  Description of Artificial Sequence: Synthetic peptide
  MOD_RES (20)..(20): Lys(C16)
  C-term amide
HGQGTFTSDYSKYLDERRAKDFVQWLLNT

SEQ ID NO: 734 - protein, 29 aa, Artificial Sequence
  Description of Artificial Sequence: Synthetic peptide
  MOD_RES (20)..(20): Lys(C18)
  C-term amide
HGQGTFTSDYSKYLDERRAKDFVQWLLNT

SEQ ID NO: 735 - protein, 29 aa, Artificial Sequence
  Description of Artificial Sequence: Synthetic peptide
  MOD_RES (20)..(20): Lys(C20)
  C-term amide
HGQGTFTSDYSKYLDERRAKDFVQWLLNT

SEQ ID NO: 736 - protein, 29 aa, Artificial Sequence
  Description of Artificial Sequence: Synthetic peptide
  MOD_RES (2)..(2): Aib
  MOD_RES (17)..(17): Lys(C8)
  C-term amide
HXQGTFTSDYSKYLDEKAAKEFIAWLLNT

SEQ ID NO: 737 - protein, 29 aa, Artificial Sequence
  Description of Artificial Sequence: Synthetic peptide
  MOD_RES (2)..(2): Aib
  MOD_RES (17)..(17): Lys(C12)
  C-term amide
HXQGTFTSDYSKYLDEKAAKEFIAWLLNT

SEQ ID NO: 738 - protein, 29 aa, Artificial Sequence
  Description of Artificial Sequence: Synthetic peptide
  MOD_RES (2)..(2): Aib
  MOD_RES (17)..(17): Lys(C14)
  C-term amide
HXQGTFTSDYSKYLDEKAAKEFIAWLLNT

SEQ ID NO: 739 - protein, 29 aa, Artificial Sequence
  Description of Artificial Sequence: Synthetic peptide
  MOD_RES (2)..(2): Aib
  MOD_RES (17)..(17): Lys(C16)
  C-term amide
HXQGTFTSDYSKYLDEKAAKEFIAWLLNT

SEQ ID NO: 740 - protein, 29 aa, Artificial Sequence
  Description of Artificial Sequence: Synthetic peptide
  MOD_RES (2)..(2): Aib
  MOD_RES (17)..(17): Lys(C18)
  C-term amide
HXQGTFTSDYSKYLDEKAAKEFIAWLLNT

SEQ ID NO: 741 - protein, 29 aa, Artificial Sequence
  Description of Artificial Sequence: Synthetic peptide
  MOD_RES (2)..(2): Aib
  MOD_RES (17)..(17): Lys(C20)
  C-term amide
HXQGTFTSDYSKYLDEKAAKEFIAWLLNT

SEQ ID NO: 742 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C8)
  C-term amide
HXQGTFTSDYSKYLDEQAAKEFIKWLMNT

SEQ ID NO: 743 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C12)
  C-term amide
HXQGTFTSDYSKYLDEQAAKEFIKWLMNT

SEQ ID NO: 744 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C14)
  C-term amide
HXQGTFTSDYSKYLDEQAAKEFIKWLMNT

SEQ ID NO: 745 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C16)
  C-term amide
HXQGTFTSDYSKYLDEQAAKEFIKWLMNT

SEQ ID NO: 746 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C18)
  C-term amide
HXQGTFTSDYSKYLDEQAAKEFIKWLMNT

SEQ ID NO: 747 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C20)
  C-term amide
HXQGTFTSDYSKYLDEQAAKEFIKWLMNT

SEQ ID NO: 748 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C8)
  C-term amide
HXQGTFTSDYSKYLDEQAAKEFIKWLLNT

SEQ ID NO: 749 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C12)
  C-term amide
HXQGTFTSDYSKYLDEQAAKEFIKWLLNT

SEQ ID NO: 750 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C14)
  C-term amide
HXQGTFTSDYSKYLDEQAAKEFIKWLLNT

SEQ ID NO: 751 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C16)
  C-term amide
HXQGTFTSDYSKYLDEQAAKEFIKWLLNT

SEQ ID NO: 752 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C18)
  C-term amide
HXQGTFTSDYSKYLDEQAAKEFIKWLLNT

SEQ ID NO: 753 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C20)
  C-term amide
HXQGTFTSDYSKYLDEQAAKEFIKWLLNT

SEQ ID NO: 754 - protein, 29 aa, Artificial Sequence
  Description of Artificial Sequence: Synthetic peptide
  MOD_RES (24)..(24): Lys(C8)
  C-term amide
HGQGTFTSDYSKYLDEQAAREFIKWLLNT

SEQ ID NO: 755 - protein, 29 aa, Artificial Sequence
  Description of Artificial Sequence: Synthetic peptide
  MOD_RES (24)..(24): Lys(C12)
  C-term amide
HGQGTFTSDYSKYLDEQAAREFIKWLLNT

SEQ ID NO: 756 - protein, 29 aa, Artificial Sequence
  Description of Artificial Sequence: Synthetic peptide
  MOD_RES (24)..(24): Lys(C14)
  C-term amide
HGQGTFTSDYSKYLDEQAAREFIKWLLNT

SEQ ID NO: 757 - protein, 29 aa, Artificial Sequence
  Description of Artificial Sequence: Synthetic peptide
  MOD_RES (24)..(24): Lys(C16)
  C-term amide
HGQGTFTSDYSKYLDEQAAREFIKWLLNT

SEQ ID NO: 758 - protein, 29 aa, Artificial Sequence
  Description of Artificial Sequence: Synthetic peptide
  MOD_RES (24)..(24): Lys(C18)
  C-term amide
HGQGTFTSDYSKYLDEQAAREFIKWLLNT

SEQ ID NO: 759 - protein, 29 aa, Artificial Sequence
  Description of Artificial Sequence: Synthetic peptide
  MOD_RES (24)..(24): Lys(C20)
  C-term amide
HGQGTFTSDYSKYLDEQAAREFIKWLLNT

SEQ ID NO: 760 - protein, 29 aa, Artificial Sequence
  Description of Artificial Sequence: Synthetic peptide
  MOD_RES (2)..(2): Aib
  MOD_RES (17)..(17): Lys(C8)
  C-term amide
HXQGTFTSDYSKYLDEKAAREFIAWLLNT

SEQ ID NO: 761 - protein, 29 aa, Artificial Sequence
  Description of Artificial Sequence: Synthetic peptide
  MOD_RES (2)..(2): Aib
  MOD_RES (17)..(17): Lys(C12)
  C-term amide
HXQGTFTSDYSKYLDEKAAREFIAWLLNT

SEQ ID NO: 762 - protein, 29 aa, Artificial Sequence
  Description of Artificial Sequence: Synthetic peptide
  MOD_RES (2)..(2): Aib
  MOD_RES (17)..(17): Lys(C14)
  C-term amide
HXQGTFTSDYSKYLDEKAAREFIAWLLNT

SEQ ID NO: 763 - protein, 29 aa, Artificial Sequence
  Description of Artificial Sequence: Synthetic peptide
  MOD_RES (2)..(2): Aib
  MOD_RES (17)..(17): Lys(C16)
  C-term amide
HXQGTFTSDYSKYLDEKAAREFIAWLLNT

SEQ ID NO: 764 - protein, 29 aa, Artificial Sequence
  Description of Artificial Sequence: Synthetic peptide
  MOD_RES (2)..(2): Aib
  MOD_RES (17)..(17): Lys(C18)
  C-term amide
HXQGTFTSDYSKYLDEKAAREFIAWLLNT

SEQ ID NO: 765 - protein, 29 aa, Artificial Sequence
  Description of Artificial Sequence: Synthetic peptide
  MOD_RES (2)..(2): Aib
  MOD_RES (17)..(17): Lys(C20)
  C-term amide
HXQGTFTSDYSKYLDEKAAREFIAWLLNT

SEQ ID NO: 766 - protein, 29 aa, Artificial Sequence
  Description of Artificial Sequence: Synthetic peptide
  MOD_RES (24)..(24): Lys(C8)
  C-term amide
HGQGTFTSDYSKYLDERRAQDFVKWLLNT

SEQ ID NO: 767 - protein, 29 aa, Artificial Sequence
  Description of Artificial Sequence: Synthetic peptide
  MOD_RES (24)..(24): Lys(C12)
  C-term amide
HGQGTFTSDYSKYLDERRAQDFVKWLLNT

SEQ ID NO: 768 - protein, 29 aa, Artificial Sequence
  Description of Artificial Sequence: Synthetic peptide
  MOD_RES (24)..(24): Lys(C14)
  C-term amide
HGQGTFTSDYSKYLDERRAQDFVKWLLNT

SEQ ID NO: 769 - protein, 29 aa, Artificial Sequence
  Description of Artificial Sequence: Synthetic peptide
  MOD_RES (24)..(24): Lys(C16)
  C-term amide
HGQGTFTSDYSKYLDERRAQDFVKWLLNT

SEQ ID NO: 770 - protein, 29 aa, Artificial Sequence
  Description of Artificial Sequence: Synthetic peptide
  MOD_RES (24)..(24): Lys(C18)
  C-term amide
HGQGTFTSDYSKYLDERRAQDFVKWLLNT

SEQ ID NO: 771 - protein, 29 aa, Artificial Sequence
  Description of Artificial Sequence: Synthetic peptide
  MOD_RES (24)..(24): Lys(C20)
  C-term amide
HGQGTFTSDYSKYLDERRAQDFVKWLLNT

SEQ ID NO: 772 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Lys(C8)
  C-term amide
HPQGTFTSDXK

SEQ ID NO: 773 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Lys(C12)
  C-term amide
HPQGTFTSDXK

SEQ ID NO: 774 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Lys(C14)
  C-term amide
HPQGTFTSDXK

SEQ ID NO: 775 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Lys(C16)
  C-term amide
HPQGTFTSDXK

SEQ ID NO: 776 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Lys(C18)
  C-term amide
HPQGTFTSDXK

SEQ ID NO: 777 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Lys(C20)
  C-term amide
HPQGTFTSDXK

SEQ ID NO: 778 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): Lys(C8)
  C-term amide
HPQGTFTSDXK

SEQ ID NO: 779 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): Lys(C12)
  C-term amide
HPQGTFTSDXK

SEQ ID NO: 780 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): Lys(C14)
  C-term amide
HPQGTFTSDXK

SEQ ID NO: 781 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): Lys(C16)
  C-term amide
HPQGTFTSDXK

SEQ ID NO: 782 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): Lys(C18)
  C-term amide
HPQGTFTSDXK

SEQ ID NO: 783 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): Lys(C20)
  C-term amide
HPQGTFTSDXK

SEQ ID NO: 784 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): Lys(C8)
  C-term amide
HXQGTFTSDXK

SEQ ID NO: 785 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): Lys(C12)
  C-term amide
HXQGTFTSDXK

SEQ ID NO: 786 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): Lys(C14)
  C-term amide
HXQGTFTSDXK

SEQ ID NO: 787 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): Lys(C16)
  C-term amide
HXQGTFTSDXK

SEQ ID NO: 788 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): Lys(C20)
  C-term amide
HXQGTFTSDXK

SEQ ID NO: 789 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): Lys(C8)
  C-term amide
HXQGTFTSDXK

SEQ ID NO: 790 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): Lys(C12)
  C-term amide
HXQGTFTSDXK

SEQ ID NO: 791 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): Lys(C14)
  C-term amide
HXQGTFTSDXK

SEQ ID NO: 792 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): Lys(C16)
  C-term amide
HXQGTFTSDXK

SEQ ID NO: 793 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): Lys(C18)
  C-term amide
HXQGTFTSDXK

SEQ ID NO: 794 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): Lys(C20)
  C-term amide
HXQGTFTSDXK

SEQ ID NO: 795 - protein, 29 aa, Artificial Sequence
  Description of Artificial Sequence: Synthetic peptide
  MOD_RES (17)..(17): Lys(C8)
  C-term amide
HGQGTFTSDYSKYLDAKAAREFIAWLLNT

SEQ ID NO: 796 - protein, 29 aa, Artificial Sequence
  Description of Artificial Sequence: Synthetic peptide
  MOD_RES (17)..(17): Lys(C12)
  C-term amide
HGQGTFTSDYSKYLDAKAAREFIAWLLNT

SEQ ID NO: 797 - protein, 29 aa, Artificial Sequence
  Description of Artificial Sequence: Synthetic peptide
  MOD_RES (17)..(17): Lys(C14)
  C-term amide
HGQGTFTSDYSKYLDAKAAREFIAWLLNT

SEQ ID NO: 798 - protein, 29 aa, Artificial Sequence
  Description of Artificial Sequence: Synthetic peptide
  MOD_RES (17)..(17): Lys(C16)
  C-term amide
HGQGTFTSDYSKYLDAKAAREFIAWLLNT

SEQ ID NO: 799 - protein, 29 aa, Artificial Sequence
  Description of Artificial Sequence: Synthetic peptide
  MOD_RES (17)..(17): Lys(C18)
  C-term amide
HGQGTFTSDYSKYLDAKAAREFIAWLLNT

SEQ ID NO: 800 - protein, 29 aa, Artificial Sequence
  Description of Artificial Sequence: Synthetic peptide
  MOD_RES (17)..(17): Lys(C20)
  C-term amide
HGQGTFTSDYSKYLDAKAAREFIAWLLNT

SEQ ID NO: 801 - protein, 29 aa, Artificial Sequence
  Description of Artificial Sequence: Synthetic peptide
  MOD_RES (17)..(17): Lys(C8)
  C-term amide
HGQGTFTSDYSKYLDAKAAKEFIAWLLNT

SEQ ID NO: 802 - protein, 29 aa, Artificial Sequence
  Description of Artificial Sequence: Synthetic peptide
  MOD_RES (17)..(17): Lys(C12)
  C-term amide
HGQGTFTSDYSKYLDAKAAKEFIAWLLNT

SEQ ID NO: 803 - protein, 29 aa, Artificial Sequence
  Description of Artificial Sequence: Synthetic peptide
  MOD_RES (17)..(17): Lys(C14)
  C-term amide
HGQGTFTSDYSKYLDAKAAKEFIAWLLNT

SEQ ID NO: 804 - protein, 29 aa, Artificial Sequence
  Description of Artificial Sequence: Synthetic peptide
  MOD_RES (17)..(17): Lys(C16)
  C-term amide
HGQGTFTSDYSKYLDAKAAKEFIAWLLNT

SEQ ID NO: 805 - protein, 29 aa, Artificial Sequence
  Description of Artificial Sequence: Synthetic peptide
  MOD_RES (17)..(17): Lys(C18)
  C-term amide
HGQGTFTSDYSKYLDAKAAKEFIAWLLNT

SEQ ID NO: 806 - protein, 29 aa, Artificial Sequence
  Description of Artificial Sequence: Synthetic peptide
  MOD_RES (17)..(17): Lys(C20)
  C-term amide
HGQGTFTSDYSKYLDAKAAKEFIAWLLNT

SEQ ID NO: 807 - protein, 29 aa, Artificial Sequence
  Description of Artificial Sequence: Synthetic peptide
  MOD_RES (16)..(16): Aib
  MOD_RES (17)..(17): Lys(C8)
  C-term amide
HGQGTFTSDYSKYLDXKAAKEFIAWLLNT

SEQ ID NO: 808 - protein, 29 aa, Artificial Sequence
  Description of Artificial Sequence: Synthetic peptide
  MOD_RES (16)..(16): Aib
  MOD_RES (17)..(17): Lys(C12)
  C-term amide
HGQGTFTSDYSKYLDXKAAKEFIAWLLNT

SEQ ID NO: 809 - protein, 29 aa, Artificial Sequence
  Description of Artificial Sequence: Synthetic peptide
  MOD_RES (16)..(16): Aib
  MOD_RES (17)..(17): Lys(C14)
  C-term amide
HGQGTFTSDYSKYLDXKAAKEFIAWLLNT

SEQ ID NO: 810 - protein, 29 aa, Artificial Sequence
  Description of Artificial Sequence: Synthetic peptide
  MOD_RES (16)..(16): Aib
  MOD_RES (17)..(17): Lys(C16)
  C-term amide
HGQGTFTSDYSKYLDXKAAKEFIAWLLNT

SEQ ID NO: 811 - protein, 29 aa, Artificial Sequence
  Description of Artificial Sequence: Synthetic peptide
  MOD_RES (16)..(16): Aib
  MOD_RES (17)..(17): Lys(C18)
  C-term amide
HGQGTFTSDYSKYLDXKAAKEFIAWLLNT

SEQ ID NO: 812 - protein, 29 aa, Artificial Sequence
  Description of Artificial Sequence: Synthetic peptide
  MOD_RES (16)..(16): Aib
  MOD_RES (17)..(17): Lys(C20)
  C-term amide
HGQGTFTSDYSKYLDXKAAKEFIAWLLNT

SEQ ID NO: 813 - protein, 29 aa, Artificial Sequence
  Description of Artificial Sequence: Synthetic peptide
  MOD_RES (16)..(16): Aib
  MOD_RES (17)..(17): Lys(C8)
  C-term amide
HGQGTFTSDYSKYLDXKAAREFIAWLLNT

SEQ ID NO: 814 - protein, 29 aa, Artificial Sequence
  Description of Artificial Sequence: Synthetic peptide
  MOD_RES (16)..(16): Aib
  MOD_RES (17)..(17): Lys(C12)
  C-term amide
HGQGTFTSDYSKYLDXKAAREFIAWLLNT

SEQ ID NO: 815 - protein, 29 aa, Artificial Sequence
  Description of Artificial Sequence: Synthetic peptide
  MOD_RES (16)..(16): Aib
  MOD_RES (17)..(17): Lys(C14)
  C-term amide
HGQGTFTSDYSKYLDXKAAREFIAWLLNT

SEQ ID NO: 816 - protein, 29 aa, Artificial Sequence
  Description of Artificial Sequence: Synthetic peptide
  MOD_RES (16)..(16): Aib
  MOD_RES (17)..(17): Lys(C16)
  C-term amide
HGQGTFTSDYSKYLDXKAAREFIAWLLNT

SEQ ID NO: 817 - protein, 29 aa, Artificial Sequence
  Description of Artificial Sequence: Synthetic peptide
  MOD_RES (16)..(16): Aib
  MOD_RES (17)..(17): Lys(C18)
  C-term amide
HGQGTFTSDYSKYLDXKAAREFIAWLLNT

SEQ ID NO: 818 - protein, 29 aa, Artificial Sequence
  Description of Artificial Sequence: Synthetic peptide
  MOD_RES (16)..(16): Aib
  MOD_RES (17)..(17): Lys(C20)
  C-term amide
HGQGTFTSDYSKYLDXKAAREFIAWLLNT

SEQ ID NO: 819 - protein, 29 aa, Artificial Sequence
  Description of Artificial Sequence: Synthetic peptide
  MOD_RES (2)..(2): Aib
  MOD_RES (17)..(17): Lys(C8)
  C-term amide
HXQGTFTSDYSKYLDAKAAKEFIAWLLNT

SEQ ID NO: 820 - protein, 29 aa, Artificial Sequence
  Description of Artificial Sequence: Synthetic peptide
  MOD_RES (2)..(2): Aib
  MOD_RES (17)..(17): Lys(C12)
  C-term amide
HXQGTFTSDYSKYLDAKAAKEFIAWLLNT

SEQ ID NO: 821 - protein, 29 aa, Artificial Sequence
  Description of Artificial Sequence: Synthetic peptide
  MOD_RES (2)..(2): Aib
  MOD_RES (17)..(17): Lys(C14)
  C-term amide
HXQGTFTSDYSKYLDAKAAKEFIAWLLNT

SEQ ID NO: 822 - protein, 29 aa, Artificial Sequence
  Description of Artificial Sequence: Synthetic peptide
  MOD_RES (2)..(2): Aib
  MOD_RES (17)..(17): Lys(C16)
  C-term amide
HXQGTFTSDYSKYLDAKAAKEFIAWLLNT

SEQ ID NO: 823 - protein, 29 aa, Artificial Sequence
  Description of Artificial Sequence: Synthetic peptide
  MOD_RES (2)..(2): Aib
  MOD_RES (17)..(17): Lys(C18)
  C-term amide
HXQGTFTSDYSKYLDAKAAKEFIAWLLNT

SEQ ID NO: 824 - protein, 29 aa, Artificial Sequence
  Description of Artificial Sequence: Synthetic peptide
  MOD_RES (2)..(2): Aib
  MOD_RES (17)..(17): Lys(C20)
  C-term amide
HXQGTFTSDYSKYLDAKAAKEFIAWLLNT

SEQ ID NO: 825 - protein, 29 aa, Artificial Sequence
  Description of Artificial Sequence: Synthetic peptide
  MOD_RES (2)..(2): Aib
  MOD_RES (17)..(17): Lys(C8)
  C-term amide
HXQGTFTSDYSKYLDAKAAREFIAWLLNT

SEQ ID NO: 826 - protein, 29 aa, Artificial Sequence
  Description of Artificial Sequence: Synthetic peptide
  MOD_RES (2)..(2): Aib
  MOD_RES (17)..(17): Lys(C12)
  C-term amide
HXQGTFTSDYSKYLDAKAAREFIAWLLNT

SEQ ID NO: 827 - protein, 29 aa, Artificial Sequence
  Description of Artificial Sequence: Synthetic peptide
  MOD_RES (2)..(2): Aib
  MOD_RES (17)..(17): Lys(C14)
  C-term amide
HXQGTFTSDYSKYLDAKAAREFIAWLLNT

SEQ ID NO: 828 - protein, 29 aa, Artificial Sequence
  Description of Artificial Sequence: Synthetic peptide
  MOD_RES (2)..(2): Aib
  MOD_RES (17)..(17): Lys(C16)
  C-term amide
HXQGTFTSDYSKYLDAKAAREFIAWLLNT

SEQ ID NO: 829 - protein, 29 aa, Artificial Sequence
  Description of Artificial Sequence: Synthetic peptide
  MOD_RES (2)..(2): Aib
  MOD_RES (17)..(17): Lys(C18)
  C-term amide
HXQGTFTSDYSKYLDAKAAREFIAWLLNT

SEQ ID NO: 830 - protein, 29 aa, Artificial Sequence
  Description of Artificial Sequence: Synthetic peptide
  MOD_RES (2)..(2): Aib
  MOD_RES (17)..(17): Lys(C20)
  C-term amide
HXQGTFTSDYSKYLDAKAAREFIAWLLNT

SEQ ID NO: 831 - protein, 29 aa, Artificial Sequence
  Description of Artificial Sequence: Synthetic peptide
  MOD_RES (24)..(24): Lys(C8)
  C-term amide
HGQGTFTSDYSKYLDAQAAREFIKWLLNT

SEQ ID NO: 832 - protein, 29 aa, Artificial Sequence
  Description of Artificial Sequence: Synthetic peptide
  MOD_RES (24)..(24): Lys(C12)
  C-term amide
HGQGTFTSDYSKYLDAQAAREFIKWLLNT

SEQ ID NO: 833 - protein, 29 aa, Artificial Sequence
  Description of Artificial Sequence: Synthetic peptide
  MOD_RES (24)..(24): Lys(C14)
  C-term amide
HGQGTFTSDYSKYLDAQAAREFIKWLLNT

SEQ ID NO: 834 - protein, 29 aa, Artificial Sequence
  Description of Artificial Sequence: Synthetic peptide
  MOD_RES (24)..(24): Lys(C16)
  C-term amide
HGQGTFTSDYSKYLDAQAAREFIKWLLNT

SEQ ID NO: 835 - protein, 29 aa, Artificial Sequence
  Description of Artificial Sequence: Synthetic peptide
  MOD_RES (24)..(24): Lys(C18)
  C-term amide
HGQGTFTSDYSKYLDAQAAREFIKWLLNT

SEQ ID NO: 836 - protein, 29 aa, Artificial Sequence
  Description of Artificial Sequence: Synthetic peptide
  MOD_RES (24)..(24): Lys(C20)
  C-term amide
HGQGTFTSDYSKYLDAQAAREFIKWLLNT

SEQ ID NO: 837 - protein, 29 aa, Artificial Sequence
  Description of Artificial Sequence: Synthetic peptide
  MOD_RES (20)..(20): Lys(C8)
  C-term amide
HGQGTFTSDYSKYLDARRAKDFVQWLLNT

SEQ ID NO: 838 - protein, 29 aa, Artificial Sequence
  Description of Artificial Sequence: Synthetic peptide
  MOD_RES (20)..(20): Lys(12)
  C-term amide
HGQGTFTSDYSKYLDARRAKDFVQWLLNT

SEQ ID NO: 839 - protein, 29 aa, Artificial Sequence
  Description of Artificial Sequence: Synthetic peptide
  MOD_RES (20)..(20): Lys(C14)
  C-term amide
HGQGTFTSDYSKYLDARRAKDFVQWLLNT

SEQ ID NO: 840 - protein, 29 aa, Artificial Sequence
  Description of Artificial Sequence: Synthetic peptide
  MOD_RES (20)..(20): Lys(C16)
  C-term amide
HGQGTFTSDYSKYLDARRAKDFVQWLLNT

SEQ ID NO: 841 - protein, 29 aa, Artificial Sequence
  Description of Artificial Sequence: Synthetic peptide
  MOD_RES (20)..(20): Lys(C18)
  C-term amide
HGQGTFTSDYSKYLDARRAKDFVQWLLNT

SEQ ID NO: 842 - protein, 29 aa, Artificial Sequence
  Description of Artificial Sequence: Synthetic peptide
  MOD_RES (20)..(20): Lys(C20)
  C-term amide
HGQGTFTSDYSKYLDARRAKDFVQWLLNT

SEQ ID NO: 843 - protein, 29 aa, Artificial Sequence
  Description of Artificial Sequence: Synthetic peptide
  MOD_RES (2)..(2): Aib
  MOD_RES (20)..(20): Lys(C18)
  C-term amide
HXQGTFTSDYSKYLDARRAKDFVQWLLNT

SEQ ID NO: 844 - protein, 29 aa, Artificial Sequence
  Description of Artificial Sequence: Synthetic peptide
  MOD_RES (2)..(2): Aib
  MOD_RES (20)..(20): Lys(C8)
  C-term amide
HXQGTFTSDYSKYLDARRAKDFVQWLLNT

SEQ ID NO: 845 - protein, 29 aa, Artificial Sequence
  Description of Artificial Sequence: Synthetic peptide
  MOD_RES (2)..(2): Aib
  MOD_RES (20)..(20): Lys(C14)
  C-term amide
HXQGTFTSDYSKYLDARRAKDFVQWLLNT

SEQ ID NO: 846 - protein, 29 aa, Artificial Sequence
  Description of Artificial Sequence: Synthetic peptide
  MOD_RES (2)..(2): Aib
  MOD_RES (20)..(20): Lys(C16)
  C-term amide
HXQGTFTSDYSKYLDARRAKDFVQWLLNT

SEQ ID NO: 847 - protein, 29 aa, Artificial Sequence
  Description of Artificial Sequence: Synthetic peptide
  MOD_RES (2)..(2): Aib
  MOD_RES (20)..(20): Lys(C20)
  C-term amide
HXQGTFTSDYSKYLDARRAKDFVQWLLNT

SEQ ID NO: 848 - protein, 29 aa, Artificial Sequence
  Description of Artificial Sequence: Synthetic peptide
  MOD_RES (24)..(24): Lys(C8)
  C-term amide
HGQGTFTSDYSKYLDARRAQDFVKWLLNT

SEQ ID NO: 849 - protein, 29 aa, Artificial Sequence
  Description of Artificial Sequence: Synthetic peptide
  MOD_RES (24)..(24): Lys(C12)
  C-term amide
HGQGTFTSDYSKYLDARRAQDFVKWLLNT

SEQ ID NO: 850 - protein, 29 aa, Artificial Sequence
  Description of Artificial Sequence: Synthetic peptide
  MOD_RES (24)..(24): Lys(C14)
  C-term amide
HGQGTFTSDYSKYLDARRAQDFVKWLLNT

SEQ ID NO: 851 - protein, 29 aa, Artificial Sequence
  Description of Artificial Sequence: Synthetic peptide
  MOD_RES (24)..(24): Lys(C16)
  C-term amide
HGQGTFTSDYSKYLDARRAQDFVKWLLNT

SEQ ID NO: 852 - protein, 29 aa, Artificial Sequence
  Description of Artificial Sequence: Synthetic peptide
  MOD_RES (24)..(24): Lys(C18)
  C-term amide
HGQGTFTSDYSKYLDARRAQDFVKWLLNT

SEQ ID NO: 853 - protein, 29 aa, Artificial Sequence
  Description of Artificial Sequence: Synthetic peptide
  MOD_RES (24)..(24): Lys(C20)
  C-term amide
HGQGTFTSDYSKYLDARRAQDFVKWLLNT

SEQ ID NO: 854 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C18)
  C-term amide
HXQGTFTSDYSKYLDXKAAKEFIAWLLNT

SEQ ID NO: 855 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C8)
  C-term amide
HXQGTFTSDYSKYLDXKAAKEFIAWLLNT

SEQ ID NO: 856 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C12)
  C-term amide
HXQGTFTSDYSKYLDXKAAKEFIAWLLNT

SEQ ID NO: 857 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C14)
  C-term amide
HXQGTFTSDYSKYLDXKAAKEFIAWLLNT

SEQ ID NO: 858 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C16)
  C-term amide
HXQGTFTSDYSKYLDXKAAKEFIAWLLNT

SEQ ID NO: 859 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C18)
  C-term amide
HXQGTFTSDYSKYLDXKAAKEFIAWLLNT

SEQ ID NO: 860 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C20)
  C-term amide
HXQGTFTSDYSKYLDXKAAKEFIAWLLNT

SEQ ID NO: 861 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C8)
  C-term amide
HXQGTFTSDYSKYLDXKAAREFIAWLLNT

SEQ ID NO: 862 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C12)
  C-term amide
HXQGTFTSDYSKYLDXKAAREFIAWLLNT

SEQ ID NO: 863 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C14)
  C-term amide
HXQGTFTSDYSKYLDXKAAREFIAWLLNT

SEQ ID NO: 864 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C16)
  C-term amide
HXQGTFTSDYSKYLDXKAAREFIAWLLNT

SEQ ID NO: 865 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C18)
  C-term amide
HXQGTFTSDYSKYLDXKAAREFIAWLLNT

SEQ ID NO: 866 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C20)
  C-term amide
HXQGTFTSDYSKYLDXKAAREFIAWLLNT

SEQ ID NO: 867 - protein, 29 aa, Artificial Sequence
  Description of Artificial Sequence: Synthetic peptide
  MOD_RES (2)..(2): Aib
  MOD_RES (16)..(16): Aib
  MOD_RES (20)..(20): Lys(C18)
  C-term amide
HXQGTFTSDYSKYLDXRRAKDFVQWLLNT

SEQ ID NO: 868 - protein, 29 aa, Artificial Sequence
  Description of Artificial Sequence: Synthetic peptide
  MOD_RES (2)..(2): Aib
  MOD_RES (16)..(16): Aib
  MOD_RES (20)..(20): Lys(C8)
  C-term amide
HXQGTFTSDYSKYLDXRRAKDFVQWLLNT

SEQ ID NO: 869 - protein, 29 aa, Artificial Sequence
  Description of Artificial Sequence: Synthetic peptide
  MOD_RES (2)..(2): Aib
  MOD_RES (16)..(16): Aib
  MOD_RES (20)..(20): Lys(C14)
  C-term amide
HXQGTFTSDYSKYLDXRRAKDFVQWLLNT

SEQ ID NO: 870 - protein, 29 aa, Artificial Sequence
  Description of Artificial Sequence: Synthetic peptide
  MOD_RES (2)..(2): Aib
  MOD_RES (16)..(16): Aib
  MOD_RES (20)..(20): Lys(C16)
  C-term amide
HXQGTFTSDYSKYLDXRRAKDFVQWLLNT

SEQ ID NO: 871 - protein, 29 aa, Artificial Sequence
  Description of Artificial Sequence: Synthetic peptide
  MOD_RES (2)..(2): Aib
  MOD_RES (16)..(16): Aib
  MOD_RES (20)..(20): Lys(C20)
  C-term amide
HXQGTFTSDYSKYLDXRRAKDFVQWLLNT

SEQ ID NO: 872 - protein, 29 aa, Artificial Sequence
  Description of Artificial Sequence: Synthetic peptide
  MOD_RES (16)..(16): Aib
  MOD_RES (20)..(20): Lys(C8)
  C-term amide
HGQGTFTSDYSKYLDXRRAKDFVQWLLNT

SEQ ID NO: 873 - protein, 29 aa, Artificial Sequence
  Description of Artificial Sequence: Synthetic peptide
  MOD_RES (16)..(16): Aib
  MOD_RES (20)..(20): Lys(C12)
  C-term amide
HGQGTFTSDYSKYLDXRRAKDFVQWLLNT

SEQ ID NO: 874 - protein, 29 aa, Artificial Sequence
  Description of Artificial Sequence: Synthetic peptide
  MOD_RES (16)..(16): Aib
  MOD_RES (20)..(20): Lys(C14)
  C-term amide
HGQGTFTSDYSKYLDXRRAKDFVQWLLNT

SEQ ID NO: 875 - protein, 29 aa, Artificial Sequence
  Description of Artificial Sequence: Synthetic peptide
  MOD_RES (16)..(16): Aib
  MOD_RES (20)..(20): Lys(C16)
  C-term amide
HGQGTFTSDYSKYLDXRRAKDFVQWLLNT

SEQ ID NO: 876 - protein, 29 aa, Artificial Sequence
  Description of Artificial Sequence: Synthetic peptide
  MOD_RES (16)..(16): Aib
  MOD_RES (20)..(20): Lys(C18)
  C-term amide
HGQGTFTSDYSKYLDXRRAKDFVQWLLNT

SEQ ID NO: 877 - protein, 29 aa, Artificial Sequence
  Description of Artificial Sequence: Synthetic peptide
  MOD_RES (16)..(16): Aib
  MOD_RES (20)..(20): Lys(C20)
  C-term amide
HGQGTFTSDYSKYLDXRRAKDFVQWLLNT

SEQ ID NO: 878 - protein, 29 aa, Artificial Sequence
  Description of Artificial Sequence: Synthetic peptide
  MOD_RES (16)..(16): Aib
  MOD_RES (24)..(24): Lys(C8)
  C-term amide
HGQGTFTSDYSKYLDXQAAREFIKWLLNT

SEQ ID NO: 879 - protein, 29 aa, Artificial Sequence
  Description of Artificial Sequence: Synthetic peptide
  MOD_RES (16)..(16): Aib
  MOD_RES (24)..(24): Lys(C12)
  C-term amide
HGQGTFTSDYSKYLDXQAAREFIKWLLNT

SEQ ID NO: 880 - protein, 29 aa, Artificial Sequence
  Description of Artificial Sequence: Synthetic peptide
  MOD_RES (16)..(16): Aib
  MOD_RES (24)..(24): Lys(C14)
  C-term amide
HGQGTFTSDYSKYLDXQAAREFIKWLLNT

SEQ ID NO: 881 - protein, 29 aa, Artificial Sequence
  Description of Artificial Sequence: Synthetic peptide
  MOD_RES (16)..(16): Aib
  MOD_RES (24)..(24): Lys(C16)
  C-term amide
HGQGTFTSDYSKYLDXQAAREFIKWLLNT

SEQ ID NO: 882 - protein, 29 aa, Artificial Sequence
  Description of Artificial Sequence: Synthetic peptide
  MOD_RES (16)..(16): Aib
  MOD_RES (24)..(24): Lys(C18)
  C-term amide
HGQGTFTSDYSKYLDXQAAREFIKWLLNT

SEQ ID NO: 883 - protein, 29 aa, Artificial Sequence
  Description of Artificial Sequence: Synthetic peptide
  MOD_RES (16)..(16): Aib
  MOD_RES (24)..(24): Lys(C20)
  C-term amide
HGQGTFTSDYSKYLDXQAAREFIKWLLNT

SEQ ID NO: 884 - protein, 29 aa, Artificial Sequence
  Description of Artificial Sequence: Synthetic peptide
  MOD_RES (16)..(16): Aib
  MOD_RES (24)..(24): Lys(C8)
  C-term amide
HGQGTFTSDYSKYLDXRRAQDFVKWLLNT

SEQ ID NO: 885 - protein, 29 aa, Artificial Sequence
  Description of Artificial Sequence: Synthetic peptide
  MOD_RES (16)..(16): Aib
  MOD_RES (24)..(24): Lys(C12)
  C-term amide
HGQGTFTSDYSKYLDXRRAQDFVKWLLNT

SEQ ID NO: 886 - protein, 29 aa, Artificial Sequence
  Description of Artificial Sequence: Synthetic peptide
  MOD_RES (16)..(16): Aib
  MOD_RES (24)..(24): Lys(C14)
  C-term amide
HGQGTFTSDYSKYLDXRRAQDFVKWLLNT

SEQ ID NO: 887 - protein, 29 aa, Artificial Sequence
  Description of Artificial Sequence: Synthetic peptide
  MOD_RES (16)..(16): Aib
  MOD_RES (24)..(24): Lys(C16)
  C-term amide
HGQGTFTSDYSKYLDXRRAQDFVKWLLNT

SEQ ID NO: 888 - protein, 29 aa, Artificial Sequence
  Description of Artificial Sequence: Synthetic peptide
  MOD_RES (16)..(16): Aib
  MOD_RES (24)..(24): Lys(C18)
  C-term amide
HGQGTFTSDYSKYLDXRRAQDFVKWLLNT

SEQ ID NO: 889 - protein, 29 aa, Artificial Sequence
  Description of Artificial Sequence: Synthetic peptide
  MOD_RES (16)..(16): Aib
  MOD_RES (24)..(24): Lys(C20)
  C-term amide
HGQGTFTSDYSKYLDXRRAQDFVKWLLNT

SEQ ID NO: 890 - protein, 29 aa, Artificial Sequence
  Description of Artificial Sequence: Synthetic peptide
  MOD_RES (24)..(24): Lys(C8)
  C-term amide
HGQGTFTSDYSKYLDEQAAREFIKWLLQT

SEQ ID NO: 891 - protein, 29 aa, Artificial Sequence
  Description of Artificial Sequence: Synthetic peptide
  MOD_RES (24)..(24): Lys(C12)
  C-term amide
HGQGTFTSDYSKYLDEQAAREFIKWLLQT

SEQ ID NO: 892 - protein, 29 aa, Artificial Sequence
  Description of Artificial Sequence: Synthetic peptide
  MOD_RES (24)..(24): Lys(C14)
  C-term amide
HGQGTFTSDYSKYLDEQAAREFIKWLLQT

SEQ ID NO: 893 - protein, 29 aa, Artificial Sequence
  Description of Artificial Sequence: Synthetic peptide
  MOD_RES (24)..(24): Lys(C16)
  C-term amide
HGQGTFTSDYSKYLDEQAAREFIKWLLQT

SEQ ID NO: 894 - protein, 29 aa, Artificial Sequence
  Description of Artificial Sequence: Synthetic peptide
  MOD_RES (24)..(24): Lys(C18)
  C-term amide
HGQGTFTSDYSKYLDEQAAREFIKWLLQT

SEQ ID NO: 895 - protein, 29 aa, Artificial Sequence
  Description of Artificial Sequence: Synthetic peptide
  MOD_RES (24)..(24): Lys(C20)
  C-term amide
HGQGTFTSDYSKYLDEQAAREFIKWLLQT

SEQ ID NO: 896 - protein, 29 aa, Artificial Sequence
  Description of Artificial Sequence: Synthetic peptide
  MOD_RES (17)..(17): Lys(C8)
  C-term amide
HGQGTFTSDYSKYLDEKAAREFIAWLLQT

SEQ ID NO: 897 - protein, 29 aa, Artificial Sequence
  Description of Artificial Sequence: Synthetic peptide
  MOD_RES (17)..(17): Lys(C12)
  C-term amide
HGQGTFTSDYSKYLDEKAAREFIAWLLQT

SEQ ID NO: 898 - protein, 29 aa, Artificial Sequence
  Description of Artificial Sequence: Synthetic peptide
  MOD_RES (17)..(17): Lys(C14)
  C-term amide
HGQGTFTSDYSKYLDEKAAREFIAWLLQT

SEQ ID NO: 899 - protein, 29 aa, Artificial Sequence
  Description of Artificial Sequence: Synthetic peptide
  MOD_RES (17)..(17): Lys(C16)
  C-term amide
HGQGTFTSDYSKYLDEKAAREFIAWLLQT

SEQ ID NO: 900 - protein, 29 aa, Artificial Sequence
  Description of Artificial Sequence: Synthetic peptide
  MOD_RES (17)..(17): Lys(C18)
  C-term amide
HGQGTFTSDYSKYLDEKAAREFIAWLLQT

SEQ ID NO: 901 - protein, 29 aa, Artificial Sequence
  Description of Artificial Sequence: Synthetic peptide
  MOD_RES (17)..(17): Lys(C20)
  C-term amide
HGQGTFTSDYSKYLDEKAAREFIAWLLQT

SEQ ID NO: 902 - protein, 29 aa, Artificial Sequence
  Description of Artificial Sequence: Synthetic peptide
  MOD_RES (17)..(17): Lys(C8)
  C-term amide
HGQGTFTSDYSKYLDEKAAKEFIAWLLQT

SEQ ID NO: 903 - protein, 29 aa, Artificial Sequence
  Description of Artificial Sequence: Synthetic peptide
  MOD_RES (17)..(17): Lys(C12)
  C-term amide
HGQGTFTSDYSKYLDEKAAKEFIAWLLQT

SEQ ID NO: 904 - protein, 29 aa, Artificial Sequence
  Description of Artificial Sequence: Synthetic peptide
  MOD_RES (17)..(17): Lys(C14)
  C-term amide
HGQGTFTSDYSKYLDEKAAKEFIAWLLQT

SEQ ID NO: 905 - protein, 29 aa, Artificial Sequence
  Description of Artificial Sequence: Synthetic peptide
  MOD_RES (17)..(17): Lys(C16)
  C-term amide
HGQGTFTSDYSKYLDEKAAKEFIAWLLQT

SEQ ID NO: 906 - protein, 29 aa, Artificial Sequence
  Description of Artificial Sequence: Synthetic peptide
  MOD_RES (17)..(17): Lys(C18)
  C-term amide
HGQGTFTSDYSKYLDEKAAKEFIAWLLQT

SEQ ID NO: 907 - protein, 29 aa, Artificial Sequence
  Description of Artificial Sequence: Synthetic peptide
  MOD_RES (17)..(17): Lys(C20)
  C-term amide
HGQGTFTSDYSKYLDEKAAKEFIAWLLQT

SEQ ID NO: 908 - protein, 29 aa, Artificial Sequence
  Description of Artificial Sequence: Synthetic peptide
  MOD_RES (2)..(2): Aib
  MOD_RES (17)..(17): Lys(C8)
  C-term amide
HXQGTFTSDYSKYLDEKAAKEFIAWLLQT

SEQ ID NO: 909 - protein, 29 aa, Artificial Sequence
  Description of Artificial Sequence: Synthetic peptide
  MOD_RES (2)..(2): Aib
  MOD_RES (17)..(17): Lys(C12)
  C-term amide
HXQGTFTSDYSKYLDEKAAKEFIAWLLQT

SEQ ID NO: 910 - protein, 29 aa, Artificial Sequence
  Description of Artificial Sequence: Synthetic peptide
  MOD_RES (2)..(2): Aib
  MOD_RES (17)..(17): Lys(C14)
  C-term amide
HXQGTFTSDYSKYLDEKAAKEFIAWLLQT

SEQ ID NO: 911 - protein, 29 aa, Artificial Sequence
  Description of Artificial Sequence: Synthetic peptide
  MOD_RES (2)..(2): Aib
  MOD_RES (17)..(17): Lys(C16)
  C-term amide
HXQGTFTSDYSKYLDEKAAKEFIAWLLQT

SEQ ID NO: 912 - protein, 29 aa, Artificial Sequence
  Description of Artificial Sequence: Synthetic peptide
  MOD_RES (2)..(2): Aib
  MOD_RES (17)..(17): Lys(C18)
  C-term amide
HXQGTFTSDYSKYLDEKAAKEFIAWLLQT

SEQ ID NO: 913 - protein, 29 aa, Artificial Sequence
  Description of Artificial Sequence: Synthetic peptide
  MOD_RES (2)..(2): Aib
  MOD_RES (17)..(17): Lys(C20)
  C-term amide
HXQGTFTSDYSKYLDEKAAKEFIAWLLQT

SEQ ID NO: 914 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C8)
  C-term amide
HXQGTFTSDYSKYLDXKAAREFIAWLLQT

SEQ ID NO: 915 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C12)
  C-term amide
HXQGTFTSDYSKYLDXKAAREFIAWLLQT

SEQ ID NO: 916 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C14)
  C-term amide
HXQGTFTSDYSKYLDXKAAREFIAWLLQT

SEQ ID NO: 917 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C16)
  C-term amide
HXQGTFTSDYSKYLDXKAAREFIAWLLQT

SEQ ID NO: 918 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C18)
  C-term amide
HXQGTFTSDYSKYLDXKAAREFIAWLLQT

SEQ ID NO: 919 - protein, 29 aa, Artificial Sequence
  Description of Artificial Sequence: Synthetic peptide
  MOD_RES (2)..(2): Aib
  MOD_RES (16)..(16): Aib
  MOD_RES (17)..(17): Lys(C20)
  C-term amide
HXQGTFTSDYSKYLDXKAAREFIAWLLQT

SEQ ID NO: 920 - protein, 29 aa, Artificial Sequence
  Description of Artificial Sequence: Synthetic peptide
  MOD_RES (20)..(20): Lys(C8)
  C-term amide
HGQGTFTSDYSKYLDERRAKDFVQWLLQT

SEQ ID NO: 921 - protein, 29 aa, Artificial Sequence
  Description of Artificial Sequence: Synthetic peptide
  MOD_RES (20)..(20): Lys(C12)
  C-term amide
HGQGTFTSDYSKYLDERRAKDFVQWLLQT

SEQ ID NO: 922 - protein, 29 aa, Artificial Sequence
  Description of Artificial Sequence: Synthetic peptide
  MOD_RES (20)..(20): Lys(C14)
  C-term amide
HGQGTFTSDYSKYLDERRAKDFVQWLLQT

SEQ ID NO: 923 - protein, 29 aa, Artificial Sequence
  Description of Artificial Sequence: Synthetic peptide
  MOD_RES (20)..(20): Lys(C16)
  C-term amide
HGQGTFTSDYSKYLDERRAKDFVQWLLQT

SEQ ID NO: 924 - protein, 29 aa, Artificial Sequence
  Description of Artificial Sequence: Synthetic peptide
  MOD_RES (20)..(20): Lys(C18)
  C-term amide
HGQGTFTSDYSKYLDERRAKDFVQWLLQT

SEQ ID NO: 925 - protein, 29 aa, Artificial Sequence
  Description of Artificial Sequence: Synthetic peptide
  MOD_RES (20)..(20): Lys(C20)
  C-term amide
HGQGTFTSDYSKYLDERRAKDFVQWLLQT

SEQ ID NO: 926 - protein, 29 aa, Artificial Sequence
  Description of Artificial Sequence: Synthetic peptide
  MOD_RES (2)..(2): Aib
  MOD_RES (20)..(20): Lys(C8)
  C-term amide
HXQGTFTSDYSKYLDERRAKDFVQWLLQT

SEQ ID NO: 927 - protein, 29 aa, Artificial Sequence
  Description of Artificial Sequence: Synthetic peptide
  MOD_RES (2)..(2): Aib
  MOD_RES (20)..(20): Lys(C12)
  C-term amide
HXQGTFTSDYSKYLDERRAKDFVQWLLQT

SEQ ID NO: 928 - protein, 29 aa, Artificial Sequence
  Description of Artificial Sequence: Synthetic peptide
  MOD_RES (2)..(2): Aib
  MOD_RES (20)..(20): Lys(C14)
  C-term amide
HXQGTFTSDYSKYLDERRAKDFVQWLLQT

SEQ ID NO: 929 - protein, 29 aa, Artificial Sequence
  Description of Artificial Sequence: Synthetic peptide
  MOD_RES (2)..(2): Aib
  MOD_RES (20)..(20): Lys(C16)
  C-term amide
HXQGTFTSDYSKYLDERRAKDFVQWLLQT

SEQ ID NO: 930 - protein, 29 aa, Artificial Sequence
  Description of Artificial Sequence: Synthetic peptide
  MOD_RES (2)..(2): Aib
  MOD_RES (20)..(20): Lys(C18)
  C-term amide
HXQGTFTSDYSKYLDERRAKDFVQWLLQT

SEQ ID NO: 931 - protein, 29 aa, Artificial Sequence
  Description of Artificial Sequence: Synthetic peptide
  MOD_RES (2)..(2): Aib
  MOD_RES (20)..(20): Lys(C20)
  C-term amide
HXQGTFTSDYSKYLDERRAKDFVQWLLQT

SEQ ID NO: 932 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C8)
  C-term amide
HXQGTFTSDYSKYLDEQAAKEFIKWLMQT

SEQ ID NO: 933 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C12)
  C-term amide
HXQGTFTSDYSKYLDEQAAKEFIKWLMQT

SEQ ID NO: 934 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C14)
  C-term amide
HXQGTFTSDYSKYLDEQAAKEFIKWLMQT

SEQ ID NO: 935 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C16)
  C-term amide
HXQGTFTSDYSKYLDEQAAKEFIKWLMQT

SEQ ID NO: 936 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C18)
  C-term amide
HXQGTFTSDYSKYLDEQAAKEFIKWLMQT

SEQ ID NO: 937 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C20)
  C-term amide
HXQGTFTSDYSKYLDEQAAKEFIKWLMQT

SEQ ID NO: 938 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C8)
  C-term amide
HXQGTFTSDYSKYLDEQAAKEFIKWLLQT

SEQ ID NO: 939 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C12)
  C-term amide
HXQGTFTSDYSKYLDEQAAKEFIKWLLQT

SEQ ID NO: 940 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C14)
  C-term amide
HXQGTFTSDYSKYLDEQAAKEFIKWLLQT

SEQ ID NO: 941 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C16)
  C-term amide
HXQGTFTSDYSKYLDEQAAKEFIKWLLQT

SEQ ID NO: 942 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C18)
  C-term amide
HXQGTFTSDYSKYLDEQAAKEFIKWLLQT

SEQ ID NO: 943 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C20)
  C-term amide
HXQGTFTSDYSKYLDEQAAKEFIKWLLQT

SEQ ID NO: 944 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(M8)
  C-term amide
HXQGTFTSDYSKYLDEQAAKEFIKWLLQT

SEQ ID NO: 945 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(M12)
  C-term amide
HXQGTFTSDYSKYLDEQAAKEFIKWLLQT

SEQ ID NO: 946 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(M14)
  C-term amide
HXQGTFTSDYSKYLDEQAAKEFIKWLLQT

SEQ ID NO: 947 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(M16)
  C-term amide
HXQGTFTSDYSKYLDEQAAKEFIKWLLQT

SEQ ID NO: 948 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(M18)
  C-term amide
HXQGTFTSDYSKYLDEQAAKEFIKWLLQT

SEQ ID NO: 949 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(M20)
  C-term amide
HXQGTFTSDYSKYLDEQAAKEFIKWLLQT

SEQ ID NO: 950 - protein, 29 aa, Artificial Sequence
  Description of Artificial Sequence: Synthetic peptide
  MOD_RES (24)..(24): Lys(M8)
  C-term amide
HGQGTFTSDYSKYLDEQAAREFIKWLLQT

SEQ ID NO: 951 - protein, 29 aa, Artificial Sequence
  Description of Artificial Sequence: Synthetic peptide
  MOD_RES (24)..(24): Lys(M12)
  C-term amide
HGQGTFTSDYSKYLDEQAAREFIKWLLQT

SEQ ID NO: 952 - protein, 29 aa, Artificial Sequence
  Description of Artificial Sequence: Synthetic peptide
  MOD_RES (24)..(24): Lys(M14)
  C-term amide
HGQGTFTSDYSKYLDEQAAREFIKWLLQT

SEQ ID NO: 953 - protein, 29 aa, Artificial Sequence
  Description of Artificial Sequence: Synthetic peptide
  MOD_RES (24)..(24): Lys(M16)
  C-term amide
HGQGTFTSDYSKYLDEQAAREFIKWLLQT

SEQ ID NO: 954 - protein, 29 aa, Artificial Sequence
  Description of Artificial Sequence: Synthetic peptide
  MOD_RES (24)..(24): Lys(M18)
  C-term amide
HGQGTFTSDYSKYLDEQAAREFIKWLLQT

SEQ ID NO: 955 - protein, 29 aa, Artificial Sequence
  Description of Artificial Sequence: Synthetic peptide
  MOD_RES (24)..(24): Lys(M20)
  C-term amide
HGQGTFTSDYSKYLDEQAAREFIKWLLQT

SEQ ID NO: 956 - protein, 29 aa, Artificial Sequence
  Description of Artificial Sequence: Synthetic peptide
  MOD_RES (17)..(17): Lys(M8)
  C-term amide
HGQGTFTSDYSKYLDEKAAKEFIAWLLNT

SEQ ID NO: 957 - protein, 29 aa, Artificial Sequence
  Description of Artificial Sequence: Synthetic peptide
  MOD_RES (17)..(17): Lys(M12)
  C-term amide
HGQGTFTSDYSKYLDEKAAKEFIAWLLNT

SEQ ID NO: 958 - protein, 29 aa, Artificial Sequence
  Description of Artificial Sequence: Synthetic peptide
  MOD_RES (17)..(17): Lys(M14)
  C-term amide
HGQGTFTSDYSKYLDEKAAKEFIAWLLNT

SEQ ID NO: 959 - protein, 29 aa, Artificial Sequence
  Description of Artificial Sequence: Synthetic peptide
  MOD_RES (17)..(17): Lys(M16)
  C-term amide
HGQGTFTSDYSKYLDEKAAKEFIAWLLNT

SEQ ID NO: 960 - protein, 29 aa, Artificial Sequence
  Description of Artificial Sequence: Synthetic peptide
  MOD_RES (17)..(17): Lys(M18)
  C-term amide
HGQGTFTSDYSKYLDEKAAKEFIAWLLNT

SEQ ID NO: 961 - protein, 29 aa, Artificial Sequence
  Description of Artificial Sequence: Synthetic peptide
  MOD_RES (17)..(17): Lys(M20)
  C-term amide
HGQGTFTSDYSKYLDEKAAKEFIAWLLNT

SEQ ID NO: 962 - protein, 29 aa, Artificial Sequence
  Description of Artificial Sequence: Synthetic peptide
  MOD_RES (17)..(17): Lys(M8)
  C-term amide
HGQGTFTSDYSKYLDEKAAREFIAWLLQT

SEQ ID NO: 963 - protein, 29 aa, Artificial Sequence
  Description of Artificial Sequence: Synthetic peptide
  MOD_RES (17)..(17): Lys(M12)
  C-term amide
HGQGTFTSDYSKYLDEKAAREFIAWLLQT

SEQ ID NO: 964 - protein, 29 aa, Artificial Sequence
  Description of Artificial Sequence: Synthetic peptide
  MOD_RES (17)..(17): Lys(M14)
  C-term amide
HGQGTFTSDYSKYLDEKAAREFIAWLLQT

SEQ ID NO: 965 - protein, 29 aa, Artificial Sequence
  Description of Artificial Sequence: Synthetic peptide
  MOD_RES (17)..(17): Lys(M16)
  C-term amide
HGQGTFTSDYSKYLDEKAAREFIAWLLQT

SEQ ID NO: 966 - protein, 29 aa, Artificial Sequence
  Description of Artificial Sequence: Synthetic peptide
  MOD_RES (17)..(17): Lys(M18)
  C-term amide
HGQGTFTSDYSKYLDEKAAREFIAWLLQT

SEQ ID NO: 967 - protein, 29 aa, Artificial Sequence
  Description of Artificial Sequence: Synthetic peptide
  MOD_RES (17)..(17): Lys(M20)
  C-term amide
HGQGTFTSDYSKYLDEKAAREFIAWLLQT

SEQ ID NO: 968 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(Me8)
  C-term amide
HXQGTFTSDYSKYLDEQAAKEFIKWLLQT

SEQ ID NO: 969 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(Me12)
  C-term amide
HXQGTFTSDYSKYLDEQAAKEFIKWLLQT

SEQ ID NO: 970 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(Me14)
  C-term amide
HXQGTFTSDYSKYLDEQAAKEFIKWLLQT

SEQ ID NO: 971 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(Me16)
  C-term amide
HXQGTFTSDYSKYLDEQAAKEFIKWLLQT

SEQ ID NO: 972 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(Me18)
  C-term amide
HXQGTFTSDYSKYLDEQAAKEFIKWLLQT

SEQ ID NO: 973 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(Me20)
  C-term amide
HXQGTFTSDYSKYLDEQAAKEFIKWLLQT

SEQ ID NO: 974 - protein, 29 aa, Artificial Sequence
  Description of Artificial Sequence: Synthetic peptide
  MOD_RES (24)..(24): Lys(Me8)
  C-term amide
HGQGTFTSDYSKYLDEQAAREFIKWLLQT

SEQ ID NO: 975 - protein, 29 aa, Artificial Sequence
  Description of Artificial Sequence: Synthetic peptide
  MOD_RES (24)..(24): Lys(Me12)
  C-term amide
HGQGTFTSDYSKYLDEQAAREFIKWLLQT

SEQ ID NO: 976 - protein, 29 aa, Artificial Sequence
  Description of Artificial Sequence: Synthetic peptide
  MOD_RES (24)..(24): Lys(Me14)
  C-term amide
HGQGTFTSDYSKYLDEQAAREFIKWLLQT

SEQ ID NO: 977 - protein, 29 aa, Artificial Sequence
  Description of Artificial Sequence: Synthetic peptide
  MOD_RES (24)..(24): Lys(Me16)
  C-term amide
HGQGTFTSDYSKYLDEQAAREFIKWLLQT

SEQ ID NO: 978 - protein, 29 aa, Artificial Sequence
  Description of Artificial Sequence: Synthetic peptide
  MOD_RES (24)..(24): Lys(Me18)
  C-term amide
HGQGTFTSDYSKYLDEQAAREFIKWLLQT

SEQ ID NO: 979 - protein, 29 aa, Artificial Sequence
  Description of Artificial Sequence: Synthetic peptide
  MOD_RES (24)..(24): Lys(Me20)
  C-term amide
HGQGTFTSDYSKYLDEQAAREFIKWLLQT

SEQ ID NO: 980 - protein, 29 aa, Artificial Sequence
  Description of Artificial Sequence: Synthetic peptide
  MOD_RES (17)..(17): Lys(Me8)
  C-term amide
HGQGTFTSDYSKYLDEKAAKEFIAWLLNT

SEQ ID NO: 981 - protein, 29 aa, Artificial Sequence
  Description of Artificial Sequence: Synthetic peptide
  MOD_RES (17)..(17): Lys(Me12)
  C-term amide
HGQGTFTSDYSKYLDEKAAKEFIAWLLNT

SEQ ID NO: 982 - protein, 29 aa, Artificial Sequence
  Description of Artificial Sequence: Synthetic peptide
  MOD_RES (17)..(17): Lys(Me14)
  C-term amide
HGQGTFTSDYSKYLDEKAAKEFIAWLLNT

SEQ ID NO: 983 - protein, 29 aa, Artificial Sequence
  Description of Artificial Sequence: Synthetic peptide
  MOD_RES (17)..(17): Lys(Me16)
  C-term amide
HGQGTFTSDYSKYLDEKAAKEFIAWLLNT

SEQ ID NO: 984 - protein, 29 aa, Artificial Sequence
  Description of Artificial Sequence: Synthetic peptide
  MOD_RES (17)..(17): Lys(Me18)
  C-term amide
HGQGTFTSDYSKYLDEKAAKEFIAWLLNT

SEQ ID NO: 985 - protein, 29 aa, Artificial Sequence
  Description of Artificial Sequence: Synthetic peptide
  MOD_RES (17)..(17): Lys(Me20)
  C-term amide
HGQGTFTSDYSKYLDEKAAKEFIAWLLNT

SEQ ID NO: 986 - protein, 29 aa, Artificial Sequence
  Description of Artificial Sequence: Synthetic peptide
  MOD_RES (17)..(17): Lys(Me8)
  C-term amide
HGQGTFTSDYSKYLDEKAAREFIAWLLQT

SEQ ID NO: 987 - protein, 29 aa, Artificial Sequence
  Description of Artificial Sequence: Synthetic peptide
  MOD_RES (17)..(17): Lys(Me12)
  C-term amide
HGQGTFTSDYSKYLDEKAAREFIAWLLQT

SEQ ID NO: 988 - protein, 29 aa, Artificial Sequence
  Description of Artificial Sequence: Synthetic peptide
  MOD_RES (17)..(17): Lys(Me14)
  C-term amide
HGQGTFTSDYSKYLDEKAAREFIAWLLQT

SEQ ID NO: 989 - protein, 29 aa, Artificial Sequence
  Description of Artificial Sequence: Synthetic peptide
  MOD_RES (17)..(17): Lys(Me16)
  C-term amide
HGQGTFTSDYSKYLDEKAAREFIAWLLQT

SEQ ID NO: 990 - protein, 29 aa, Artificial Sequence
  Description of Artificial Sequence: Synthetic peptide
  MOD_RES (17)..(17): Lys(Me18)
  C-term amide
HGQGTFTSDYSKYLDEKAAREFIAWLLQT

SEQ ID NO: 991 - protein, 29 aa, Artificial Sequence
  Description of Artificial Sequence: Synthetic peptide
  MOD_RES (17)..(17): Lys(Me20)
  C-term amide
HGQGTFTSDYSKYLDEKAAREFIAWLLQT

SEQ ID NO: 992 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): Lys(C8)
  C-term amide
HPQGTFTSDXK

SEQ ID NO: 993 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): Lys(C12)
  C-term amide
HPQGTFTSDXK

SEQ ID NO: 994 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): Lys(C14)
  C-term amide
HPQGTFTSDXK

SEQ ID NO: 995 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): Lys(C16)
  C-term amide
HPQGTFTSDXK

SEQ ID NO: 996 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): Lys(C18)
  C-term amide
HPQGTFTSDXK

SEQ ID NO: 997 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): Lys(C20)
  C-term amide
HPQGTFTSDXK

SEQ ID NO: 998 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): Lys(C8)
  C-term amide
HPQGTFTSDXK

SEQ ID NO: 999 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): Lys(C12)
  C-term amide
HPQGTFTSDXK

SEQ ID NO: 1000 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): Lys(C14)
  C-term amide
HPQGTFTSDXK

SEQ ID NO: 1001 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): Lys(C16)
  C-term amide
HPQGTFTSDXK

SEQ ID NO: 1002 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): Lys(C18)
  C-term amide
HPQGTFTSDXK

SEQ ID NO: 1003 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): Lys(C20)
  C-term amide
HPQGTFTSDXK

SEQ ID NO: 1004 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): Lys(C8)
  C-term amide
HXQGTFTSDXK

SEQ ID NO: 1005 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): Lys(C12)
  C-term amide
HXQGTFTSDXK

SEQ ID NO: 1006 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): Lys(C14)
  C-term amide
HXQGTFTSDXK

SEQ ID NO: 1007 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): Lys(C16)
  C-term amide
HXQGTFTSDXK

SEQ ID NO: 1008 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): Lys(C18)
  C-term amide
HXQGTFTSDXK

SEQ ID NO: 1009 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): Lys(C20)
  C-term amide
HXQGTFTSDXK

SEQ ID NO: 1010 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Lys(C8)
  C-term amide
HXQGTFTSDXK

SEQ ID NO: 1011 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Lys(C12)
  C-term amide
HXQGTFTSDXK

SEQ ID NO: 1012 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Lys(C14)
  C-term amide
HXQGTFTSDXK

SEQ ID NO: 1013 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Lys(C16)
  C-term amide
HXQGTFTSDXK

SEQ ID NO: 1014 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Lys(C18)
  C-term amide
HXQGTFTSDXK

SEQ ID NO: 1015 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Lys(C20)
  C-term amide
HXQGTFTSDXK

SEQ ID NO: 1016 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): MeLys(C8)
  C-term amide
HPQGTFTSDXK

SEQ ID NO: 1017 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): MeLys(C12)
  C-term amide
HPQGTFTSDXK

SEQ ID NO: 1018 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): MeLys(C14)
  C-term amide
HPQGTFTSDXK

SEQ ID NO: 1019 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): MeLys(C16)
  C-term amide
HPQGTFTSDXK

SEQ ID NO: 1020 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): MeLys(C18)
  C-term amide
HPQGTFTSDXK

SEQ ID NO: 1021 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): MeLys(C20)
  C-term amide
HPQGTFTSDXK

SEQ ID NO: 1022 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): MeLys(C8)
  C-term amide
HPQGTFTSDXK

SEQ ID NO: 1023 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): MeLys(C12)
  C-term amide
HPQGTFTSDXK

SEQ ID NO: 1024 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): MeLys(C14)
  C-term amide
HPQGTFTSDXK

SEQ ID NO: 1025 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): MeLys(C16)
  C-term amide
HPQGTFTSDXK

SEQ ID NO: 1026 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): MeLys(C18)
  C-term amide
HPQGTFTSDXK

SEQ ID NO: 1027 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): MeLys(C20)
  C-term amide
HPQGTFTSDXK

SEQ ID NO: 1028 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): MeLys(C8)
  C-term amide
HXQGTFTSDXK

SEQ ID NO: 1029 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): MeLys(C12)
  C-term amide
HXQGTFTSDXK

SEQ ID NO: 1030 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): MeLys(C14)
  C-term amide
HXQGTFTSDXK

SEQ ID NO: 1031 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): MeLys(C16)
  C-term amide
HXQGTFTSDXK

SEQ ID NO: 1032 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): MeLys(C18)
  C-term amide
HXQGTFTSDXK

SEQ ID NO: 1033 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): MeLys(C20)
  C-term amide
HXQGTFTSDXK

SEQ ID NO: 1034 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): MeLys(C8)
  C-term amide
HXQGTFTSDXK

SEQ ID NO: 1035 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): MeLys(C12)
  C-term amide
HXQGTFTSDXK

SEQ ID NO: 1036 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): MeLys(C14)
  C-term amide
HXQGTFTSDXK

SEQ ID NO: 1037 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): MeLys(C16)
  C-term amide
HXQGTFTSDXK

SEQ ID NO: 1038 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): MeLys(C18)
  C-term amide
HXQGTFTSDXK

SEQ ID NO: 1039 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): MeLys(C20)
  C-term amide
HXQGTFTSDXK

SEQ ID NO: 1040 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): Me8
  C-term amide
HPQGTFTSDXK

SEQ ID NO: 1041 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): Me12
  C-term amide
HPQGTFTSDXK

SEQ ID NO: 1042 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): Me14
  C-term amide
HPQGTFTSDXK

SEQ ID NO: 1043 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): Me16
  C-term amide
HPQGTFTSDXK

SEQ ID NO: 1044 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): Me18
  C-term amide
HPQGTFTSDXK

SEQ ID NO: 1045 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): EtBip
  MOD_RES (11)..(11): Me20
  C-term amide
HPQGTFTSDXK

SEQ ID NO: 1046 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): Me8
  C-term amide
HPQGTFTSDXK

SEQ ID NO: 1047 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): Me12
  C-term amide
HPQGTFTSDXK

SEQ ID NO: 1048 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): Me14
  C-term amide
HPQGTFTSDXK

SEQ ID NO: 1049 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): Me16
  C-term amide
HPQGTFTSDXK

SEQ ID NO: 1050 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): Me18
  C-term amide
HPQGTFTSDXK

SEQ ID NO: 1051 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): EtBip
  MOD_RES (11)..(11): Me20
  C-term amide
HPQGTFTSDXK

SEQ ID NO: 1052 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): Me8
  C-term amide
HXQGTFTSDXK

SEQ ID NO: 1053 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): Me12
  C-term amide
HXQGTFTSDXK

SEQ ID NO: 1054 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): Me14
  C-term amide
HXQGTFTSDXK

SEQ ID NO: 1055 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): Me16
  C-term amide
HXQGTFTSDXK

SEQ ID NO: 1056 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): EtBip
  MOD_RES (11)..(11): Me18
  C-term amide
HXQGTFTSDXK

SEQ ID NO: 1057 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Me20
  C-term amide
HXQGTFTSDXK

SEQ ID NO: 1058 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Me8
  C-term amide
HXQGTFTSDXK

SEQ ID NO: 1059 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Me12
  C-term amide
HXQGTFTSDXK

SEQ ID NO: 1060 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Me14
  C-term amide
HXQGTFTSDXK

SEQ ID NO: 1061 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Me16
  C-term amide
HXQGTFTSDXK

SEQ ID NO: 1062 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Me18
  C-term amide
HXQGTFTSDXK

SEQ ID NO: 1063 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): EtBip
  MOD_RES (11)..(11): Me20
  C-term amide
HXQGTFTSDXK

SEQ ID NO: 1064 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): MeLys(C8)
  C-term amide
HPQGTFTSDXK

SEQ ID NO: 1065 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): MeLys(C12)
  C-term amide
HPQGTFTSDXK

SEQ ID NO: 1066 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): MeLys(C14)
  C-term amide
HPQGTFTSDXK

SEQ ID NO: 1067 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): MeLys(C16)
  C-term amide
HPQGTFTSDXK

SEQ ID NO: 1068 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): MeLys(C18)
  C-term amide
HPQGTFTSDXK

SEQ ID NO: 1069 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): MeLys(C20)
  C-term amide
HPQGTFTSDXK

SEQ ID NO: 1070 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): MeLys(C8)
  C-term amide
HPQGTFTSDXK

SEQ ID NO: 1071 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): MeLys(C12)
  C-term amide
HPQGTFTSDXK

SEQ ID NO: 1072 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): MeLys(C14)
  C-term amide
HPQGTFTSDXK

SEQ ID NO: 1073 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): MeLys(C16)
  C-term amide
HPQGTFTSDXK

SEQ ID NO: 1074 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): MeLys(C18)
  C-term amide
HPQGTFTSDXK

SEQ ID NO: 1075 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): MeLys(C20)
  C-term amide
HPQGTFTSDXK

SEQ ID NO: 1076 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): MeLys(C8)
  C-term amide
HXQGTFTSDXK

SEQ ID NO: 1077 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): MeLys(C12)
  C-term amide
HXQGTFTSDXK

SEQ ID NO: 1078 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): MeLys(C14)
  C-term amide
HXQGTFTSDXK

SEQ ID NO: 1079 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): MeLys(C16)
  C-term amide
HXQGTFTSDXK

SEQ ID NO: 1080 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): MeLys(C18)
  C-term amide
HXQGTFTSDXK

SEQ ID NO: 1081 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): MeLys(C20)
  C-term amide
HXQGTFTSDXK

SEQ ID NO: 1082 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): MeLys(C8)
  C-term amide
HXQGTFTSDXK

SEQ ID NO: 1083 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): MeLys(C12)
  C-term amide
HXQGTFTSDXK

SEQ ID NO: 1084 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): MeLys(C14)
  C-term amide
HXQGTFTSDXK

SEQ ID NO: 1085 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): MeLys(C16)
  C-term amide
HXQGTFTSDXK

SEQ ID NO: 1086 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): MeLys(C18)
  C-term amide
HXQGTFTSDXK

SEQ ID NO: 1087 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): MeLys(C20)
  C-term amide
HXQGTFTSDXK

SEQ ID NO: 1088 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Me8
  C-term amide
HPQGTFTSDXK

SEQ ID NO: 1089 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Me12
  C-term amide
HPQGTFTSDXK

SEQ ID NO: 1090 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Me14
  C-term amide
HPQGTFTSDXK

SEQ ID NO: 1091 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Me16
  C-term amide
HPQGTFTSDXK

SEQ ID NO: 1092 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Me18
  C-term amide
HPQGTFTSDXK

SEQ ID NO: 1093 - protein, 11 aa, Artificial Sequence
  Description of Artificial Sequence: Synthetic peptide
  MOD_RES (2)..(2): Alpha-MePro
  MOD_RES (6)..(6): Alpha-MeF
  MOD_RES (10)..(10): Bip
  MOD_RES (11)..(11): Me20
  C-term amide
HPQGTFTSDXK

SEQ ID NO: 1094 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): Me8
  C-term amide
HPQGTFTSDXK

SEQ ID NO: 1095 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): Me12
  C-term amide
HPQGTFTSDXK

SEQ ID NO: 1096 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): Me14
  C-term amide
HPQGTFTSDXK

SEQ ID NO: 1097 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): Me16
  C-term amide
HPQGTFTSDXK

SEQ ID NO: 1098 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): Me18
  C-term amide
HPQGTFTSDXK

SEQ ID NO: 1099 - protein, 11 aa, Artificial Sequence
  Description of Artificial Sequence: Synthetic peptide
  MOD_RES (2)..(2): Alpha-MePro
  MOD_RES (6)..(6): Alpha-MeFF
  MOD_RES (10)..(10): Bip
  MOD_RES (11)..(11): Me20
  C-term amide
HPQGTFTSDXK

SEQ ID NO: 1100 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): Me8
  C-term amide
HXQGTFTSDXK

SEQ ID NO: 1101 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): Me12
  C-term amide
HXQGTFTSDXK

SEQ ID NO: 1102 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): Me14
  C-term amide
HXQGTFTSDXK

SEQ ID NO: 1103 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): Me16
  C-term amide
HXQGTFTSDXK

SEQ ID NO: 1104 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): Me18
  C-term amide
HXQGTFTSDXK

SEQ ID NO: 1105 - protein, 11 aa, Artificial Sequence
  Description of Artificial Sequence: Synthetic peptide
  MOD_RES (2)..(2): Aib
  MOD_RES (6)..(6): Alpha-MeF
  MOD_RES (10)..(10): Bip
  MOD_RES (11)..(11): Me20
  C-term amide
HXQGTFTSDXK

SEQ ID NO: 1106 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): Me8
  C-term amide
HXQGTFTSDXK

SEQ ID NO: 1107 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): Me12
  C-term amide
HXQGTFTSDXK

SEQ ID NO: 1108 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): Me14
  C-term amide
HXQGTFTSDXK

SEQ ID NO: 1109 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): Me16
  C-term amide
HXQGTFTSDXK

SEQ ID NO: 1110 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): Me18
  C-term amide
HXQGTFTSDXK

SEQ ID NO: 1111 - protein, 11 aa, Artificial Sequence
  Description of Artificial Sequence: Synthetic peptide
  MOD_RES (2)..(2): Aib
  MOD_RES (6)..(6): Alpha-MeFF
  MOD_RES (10)..(10): Bip
  MOD_RES (11)..(11): Me20
  C-term amide
HXQGTFTSDXK

SEQ ID NO: 1112 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C9)
  C-term amide
HXQGTFTSDYSKYLDEQAAKEFIKWLLQT

SEQ ID NO: 1113 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C10)
  C-term amide
HXQGTFTSDYSKYLDEQAAKEFIKWLLQT

SEQ ID NO: 1114 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(C11)
  C-term amide
HXQGTFTSDYSKYLDEQAAKEFIKWLLQT

SEQ ID NO: 1115 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(alpha-Me8)
  C-term amide
HXQGTFTSDYSKYLDEQAAKEFIKWLLQT

SEQ ID NO: 1116 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(alpha-Me10)
  C-term amide
HXQGTFTSDYSKYLDEQAAKEFIKWLLQT

SEQ ID NO: 1117 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(alpha-Me12)
  C-term amide
HXQGTFTSDYSKYLDEQAAKEFIKWLLQT

SEQ ID NO: 1118 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(alpha-Me14)
  C-term amide
HXQGTFTSDYSKYLDEQAAKEFIKWLLQT

SEQ ID NO: 1119 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(alpha-Me16)
  C-term amide
HXQGTFTSDYSKYLDEQAAKEFIKWLLQT

SEQ ID NO: 1120 - protein, 29 aa, Artificial Sequence
  Description of Artificial Sequence: Synthetic peptide
  MOD_RES (2)..(2): Aib
  misc_feature (16)..(20): Cyclic
  MOD_RES (16)..(16): Glu is cyclized through side chain to form a lactam linkage
  MOD_RES (20)..(20): Lys is cyclized through side chain to form a lactam linkage
  MOD_RES (24)..(24): Lys(alpha-Me18)
  C-term amide
HXQGTFTSDYSKYLDEQAAKEFIKWLLQT

SEQ ID NO: 1121 - protein, 5 aa, Artificial Sequence
  Description of Artificial Sequence: Synthetic peptide
  MOD_RES (1)..(1): Tyr, Dmt, N-R3-Tyr, N-R3-Dmt, N-(R3)2-Tyr or N-(R3)2-Dmt
  MOD_RES (2)..(2): Pro, D-Arg, D-Cit, D-U(X), D-Ala, Tic or Tic(Psi[CH2-NH]); wherein "U" is a linking amino acid and "X" is a functionalized surfactant linked to the side chain of "U"
  MOD_RES (3)..(3): Phe, Trp, Tmp, D-or L-Nal(1), D-or L-Nal(2), C-alpha-MePhe or Psi-Phe
  MOD_RES (4)..(4): Phe, Tmp, D-or L-Nal(1), D-or L-Nal(2), U(X), D- or L-C-alpha-MeU(X); wherein "U" is a linking amino acid and "X" is a functionalized surfactant linked to the side chain of "U"
  MOD_RES (5)..(5): Absent or Pro, Aib, U(X), D- or L-C-alpha-MeU(X); wherein "U" is a linking amino acid and "X" is a functionalized surfactant linked to the side chain of "U"
  C-term OH or NH2
  see specification as filed for detailed description of substitutions and preferred embodiments
XXXXX

SEQ ID NO: 1122 - protein, 4 aa, Artificial Sequence
  Description of Artificial Sequence: Synthetic peptide
  C-term NH2
YPWF

SEQ ID NO: 1123 - protein, 4 aa, Artificial Sequence
  Description of Artificial Sequence: Synthetic peptide
  C-term NH2
YPFF

SEQ ID NO: 1124 - protein, 5 aa, Artificial Sequence
  Description of Artificial Sequence: Synthetic peptide
  N-term Ac
  MOD_RES (1)..(1): Lys(1-octyl Beta-D-glucuronide-6-yl)
  C-term NH2
KYPWF

SEQ ID NO: 1125 - protein, 4 aa, Artificial Sequence
  Description of Artificial Sequence: Synthetic peptide
  N-term Fmoc
  MOD_RES (1)..(1): Tyr(t-Bu)
  MOD_RES (3)..(3): Trp(Boc)
YPWF

SEQ ID NO: 1126 - protein, 5 aa, Artificial Sequence
  Description of Artificial Sequence: Synthetic peptide
  N-term Ac
  MOD_RES (1)..(1): Lys(Boc)
  MOD_RES (2)..(2): Tyr(t-Bu)
  MOD_RES (4)..(4): Trp(Boc)
KYPWF

SEQ ID NO: 1127 - protein, 4 aa, Artificial Sequence
  Description of Artificial Sequence: Synthetic peptide
  N-term Fmoc
  MOD_RES (1)..(1): 2'-6'dimethyl-L-Tyr
  MOD_RES (3)..(3): 2', 4', 6'-trimethyl-L-Phe
  MOD_RES (4)..(4): N-epsilon-(Alloc)-L-Lys
YPFK

SEQ ID NO: 1128 - protein, 17 aa, Artificial Sequence
  Description of Artificial Sequence: Synthetic peptide
  N-term Fmoc
  MOD_RES (1)..(1): Ac5c
  MOD_RES (3)..(3): Aib
  MOD_RES (8)..(8): Nle
  MOD_RES (17)..(17): Lys(Alloc)
XVXEIQLLHQRARWIQK

SEQ ID NO: 1129 - protein, 17 aa, Artificial Sequence
  Description of Artificial Sequence: Synthetic peptide
  N-term Fmoc
  MOD_RES (2)..(2): Aib
  MOD_RES (10)..(10): Bip
  MOD_RES (17)..(17): Lys(Alloc)
HXQGTFTSDXSKYLESK

SEQ ID NO: 1130 - protein, 29 aa, Artificial Sequence
  Description of Artificial Sequence: Synthetic peptide
  N-term Boc
  MOD_RES (1)..(1): His(Trt)
  MOD_RES (2)..(2): Aib
  MOD_RES (3)..(3): Gln(Trt)
  MOD_RES (5)..(5): Thr(tBu)
  MOD_RES (7)..(7): Thr(tBu)
  MOD_RES (8)..(8): Ser(tBu)
  MOD_RES (9)..(9): Asp(OtBu)
  MOD_RES (10)..(10): Tyr(tBu)
  MOD_RES (11)..(11): Ser(tBu)
  MOD_RES (12)..(12): Lys(Boc)
  MOD_RES (13)..(13): Tyr(tBu)
  MOD_RES (15)..(15): Asp(OtBu)
  MOD_RES (16)..(16): Glu(O-Allyl)
  MOD_RES (17)..(17): Gln(Trt)
  MOD_RES (20)..(20): Lys(Alloc)
  MOD_RES (21)..(21): Glu(O-tBu)
  MOD_RES (24)..(24): Lys(Dde)
  MOD_RES (25)..(25): Trp(Boc)
  MOD_RES (28)..(28): Gln(Trt)
  MOD_RES (29)..(29): Thr(tBu)
HXQGTFTSDYSKYLDEQAAKEFIKWLLQT

SEQ ID NO: 1131 - protein, 4 aa, Artificial Sequence
  Description of Artificial Sequence: Synthetic peptide
YLPW

SEQ ID NO: 1132 - protein, 5 aa, Artificial Sequence
  Description of Artificial Sequence: Synthetic peptide
  MOD_RES (1)..(1): Tyr, Dmt, N-R3-Tyr, N-R3-Dmt, N-(R3)2-Tyr or N-(R3)2-Dmt
  MOD_RES (2)..(2): Pro, D-Arg, D-Cit, D-U(X), D-Ala, Tic or Tic(Psi[CH2-NH]); wherein "U" is any dibasic or diacidic natural or unnatural amino acid,any natural or unnatural amino acid comprising a thiol, any unnatural amino acid comprising a -N3 group,
  MOD_RES (2)..(2): continued from above; any unnatural amino acid comprising an acetylenic group, or any unnatural amino acid comprising a -NH-C(=O)-CH2-Br or a -(CH2)m-maleimide, wherein m is 1-10, used for covalent attachment to the surfactant "X"
  MOD_RES (3)..(3): Phe, Trp, Tmp, D-or L-Nal(1), D-or L-Nal(2), C-alpha-MePhe or Psi-Phe
  MOD_RES (4)..(4): Phe, Tmp, D-or L-Nal(1), D-or L-Nal(2), U(X), D- or L-C-alpha-MeU(X);wherein "U" is any dibasic natural or unnatural amino acid, any natural or unnatural amino acid comprising a thiol, any unnatural amino acid comprising a
  MOD_RES (4)..(4): continued from above; -N3 group, any unnatural amino acid comprising an acetylenic group, or any unnatural amino acid comprising a -NH-C(=O)-CH2-Br or a -(CH2)m-maleimide, wherein m is 1-10, used for covalent attachment to the surfactant "X"
  MOD_RES (5)..(5): Absent or Pro, Aib, U(X), D- or L-C-alpha-MeU(X); wherein "U" is any dibasic natural or unnatural amino acid, any natural or unnatural amino acid comprising a thiol, any unnatural amino acid comprising a -N3 group, any unnatural amino acid comprising
  MOD_RES (5)..(5): continued from above; an acetylenic group, or any unnatural amino acid comprising a -NH-C(=O)-CH2-Br or a -(CH2)m-maleimide, wherein m is 1-10, used for covalent attachment to the surfactant "X"
  C-term OH or NH2
  see specification as filed for detailed description of substitutions and preferred embodiments
XXXXX

What is claimed is:

1. A peptide product comprising a surfactant X covalently attached to a peptide, the peptide comprising a linker amino acid U and at least three other amino acids:

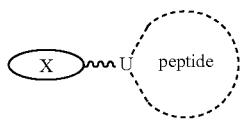

Formula I wherein X is

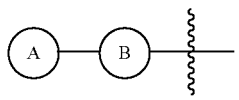

wherein:
  A is a hydrophobic group which is a substituted or unsubstituted $C_8$-$C_{20}$ alkyl group, a substituted or unsubstituted alkoxyaryl group, a substituted or unsubstituted aralkyl group, or a steroid nucleus-containing moiety, and which is attached to a saccharide at the C-1 position of the saccharide via an O- or S-glycosidic bond; and
  B is a hydrophilic saccharide group covalently attached to the peptide via the carboxy terminus of the peptide or a side chain of the linker amino acid U.

2. The peptide product of claim 1, wherein the saccharide is selected from glucose, galactose, mannose, melibiose, maltose, glucuronic acid, galacturonic acid, diglucuronic acid, mannouronic acid, melibiouronic acid and maltouronic acid.

3. The peptide product of claim 1, wherein the surfactant is a 1-alkyl glycoside class surfactant.

4. The peptide product of claim 1, wherein the hydrophilic group of the surfactant is attached to the peptide via an amide bond.

5. The peptide product of claim 1, wherein the surfactant X comprises 1-eicosyl beta-D-glucuronic acid, 1-octadecyl beta-D-glucuronic acid, 1-hexadecyl beta-D-glucuronic acid, 1-tetradecyl beta D-glucuronic acid, 1-dodecyl beta D-glucuronic acid, 1-decyl beta-D-glucuronic acid, 1-octyl beta-D-glucuronic acid, 1-eicosyl beta-D-diglucuronic acid, 1-octadecyl beta-D-diglucuronic acid, 1-hexadecyl beta-D-diglucuronic acid, 1-tetradecyl beta-D-diglucuronic acid, 1-dodecyl beta-D-diglucuronic acid, 1-decyl beta-D-diglucuronic acid, 1-octyl beta-D-diglucuronic acid, 1-eicosyl beta-D-melibiouronic acid, 1-octadecyl beta-D-melibiouronic acid, 1-hexadecyl beta-D-melibiouronic acid, 1-tetradecyl beta-D-melibiouronic acid, 1-dodecyl beta-D-melibiouronic acid, 1-decyl beta-D-melibiouronic acid, 1-octyl beta-D-melibiouronic acid, or functionalized 1-ecosyl beta-D-glucose, 1-octadecyl beta-D-glucose, 1-hexadecyl beta-D-glucose, 1-tetradecyl beta-D-glucose, 1-dodecyl beta-D-glucose, 1-decyl beta-D-glucose, 1-octyl beta-D-glucose, 1-eicosyl beta-D-maltoside, 1-octadecyl beta-D-maltoside, 1-hexadecyl beta-D-maltoside, tetradecyl maltoside, 1-dodecyl beta-D-maltoside, 1-decyl beta-D-maltoside, 1-octyl beta-D-maltoside, 1-eicosyl beta-D-melibiose, 1-octadecyl beta-D-melibiose, 1-hexadecyl beta-D-melibiose, 1-tetradecyl beta-D-melibiose, 1-dodecyl beta-D-melibiose, 1-decyl beta-D-melibiose, or 1-octyl beta-D-melibiose.

6. The peptide product of claim 1, wherein the peptide is an opioid peptide.

7. The peptide product of claim 6, wherein the peptide product has a structure of Formula IA:

$$aa_1\text{-}aa_2\text{-}aa_3\text{-}aa_4\text{-}aa_5\text{-}Z \quad \text{Formula IA}$$

wherein:
  each of $aa_1$, $aa_2$, $aa_3$, $aa_4$, and $aa_5$ is independently absent, a D- or L-natural or unnatural amino acid, an N-alkylated amino acid, an N-acetylated amino acid, a C$\alpha$R$^3$ amino acid, a $\Psi$-amino acid, or a linker amino acid U covalently attached to the surfactant X;
  Z is OH, NH$_2$ or —NHR$^3$;
  each R$^3$ is independently substituted or unsubstituted $C_1$-$C_{12}$ branched or straight chain alkyl, a PEG chain of less than 10 Da, or a substituted or unsubstituted aralkyl chain;
  provided that one, or at least one, of $aa_1$, $aa_2$, $aa_3$, $aa_4$, and $aa_5$ is the linker amino acid U covalently attached to the surfactant X; and
  further provided that not all of $aa_1$, $aa_2$, $aa_3$, $aa_4$, and $aa_5$ are absent.

8. A peptide product having a structure of Formula II:

$$aa_1\text{-}aa_2\text{-}aa_3\text{-}aa_4\text{-}aa_5\text{-}Z \quad \text{Formula II}$$

wherein:
  each of $aa_1$, $aa_2$, $aa_3$, $aa_4$, and $aa_5$ is independently a D- or L-natural or unnatural amino acid, an N-alkylated amino acid, an N-acetylated amino acid, a C$\alpha$R$^3$ amino acid, a $\Psi$-amino acid, or a linker amino acid U covalently attached to a surfactant X, or $aa_5$ can be absent;
  Z is —OH, —NH$_2$ or —NHR$^3$;
  each R$^3$ is independently substituted or unsubstituted $C_1$-$C_{12}$ branched or straight chain alkyl, a PEG chain of less than 10 Da, or a substituted or unsubstituted aralkyl chain; and
  X is

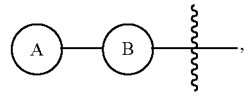

wherein:
  A is a hydrophobic group which is a substituted or unsubstituted $C_1$-$C_{30}$ alkyl group, a substituted or unsubstituted alkoxyaryl group, a substituted or unsubstituted aralkyl group, or a steroid nucleus-containing moiety, and which is attached to a saccharide at the C-1 position of the saccharide via an O- or S-glycosidic bond; and
  B is a hydrophilic saccharide group covalently attached to the peptide via the carboxy terminus of the peptide or a side chain of a linker amino acid U;
  provided that one, or at least one, of aa1, aa2, aa3, aa4, and aa5 is a linker amino acid U covalently attached to the surfactant X; and further provided that at least $aa_1$, $aa_2$, $aa_3$, and am are present.

9. The peptide product of claim 8, wherein the peptide product has a structure of Formula III:

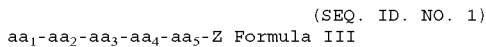

$aa_1$-$aa_2$-$aa_3$-$aa_4$-$aa_5$-Z  Formula III (SEQ. ID. NO. 1)

wherein:
  $aa_1$ is Tyr, Dmt, N—$R^3$-Tyr, N—$R^3$-Dmt, N—$(R^3)_2$-Tyr, or N—$(R^3)_2$-Dmt;
  $aa_2$ is Pro, D-Arg, D-U(X), D-Ala, D-Cit, Tic, or Tic(Ψ[CH2-NH]);
  $aa_3$ is Phe, Trp, Tmp, D- or L-Nal(1), D- or L-Nal(2), CαMePhe, or Ψ-Phe;
  $aa_4$ is Phe, Tmp, D- or L-Nal(1), D- or L-Nal(2), U(X), or D- or L-CαMeU(X);
  $aa_5$ is absent or Pro, Aib, U(X), or D- or L-CαMeU(X); and
  U is a linker amino acid covalently attached to the surfactant X and is a dibasic or diacidic natural or unnatural amino acid, a natural or unnatural amino acid comprising a thiol, an unnatural amino acid comprising a —$N_3$ group, an unnatural amino acid comprising an acetylenic group, or an unnatural amino acid comprising a —NH—C(=O)—$CH_2$—Br or a —$(CH_2)_m$-maleimide group, wherein m is 1-10.

10. The peptide product of claim 9, wherein X has the structure:

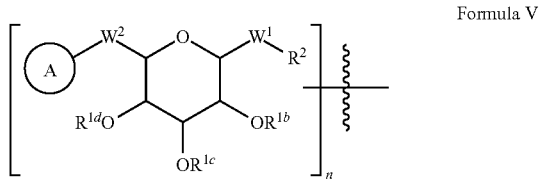

Formula V wherein:
  A is a substituted or unsubstituted $C_1$-$C_{30}$ alkyl chain, a substituted or unsubstituted alkoxyaryl group, a substituted or unsubstituted aralkyl group, or a steroid nucleus containing moiety;
  $R^{1b}$, $R^{1c}$, and $R^{1d}$ are each, independently at each occurrence, H, a protecting group, or a substituted or unsubstituted $C_1$-$C_{30}$ alkyl group;
  $W^1$ is independently, at each occurrence, —$CH_2$—, —$CH_2$—O—, —(C=O)—, —(C=O)—O—, —(C=O)—NH—, —(C=S)—, —(C=S)—NH—, or —$CH_2$—S—;
  $W^2$ is —O— or —S—;
  $R^2$ is a bond, $C_2$-$C_4$-alkene, $C_2$-$C_4$-alkyne, or —$(CH_2)_m$-maleimide;
  m is 1-10; and
  n is 1, 2 or 3.

11. The peptide product of claim 10, wherein X has the structure:

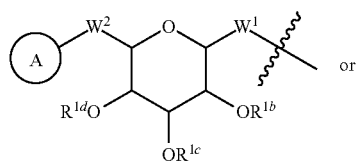 or

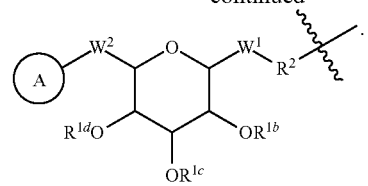

12. The peptide product of claim 10, wherein X has the structure:

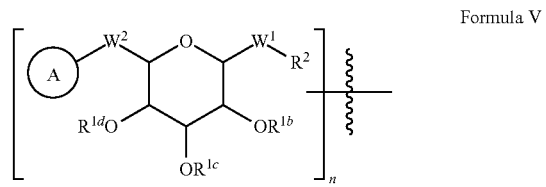

Formula V wherein:
  (1) A is a substituted or unsubstituted $C_1$-$C_{30}$ alkyl group, or a steroid nucleus containing moiety;
      $R^{1b}$, $R^{1c}$, and $R^{1d}$ are each, independently at each occurrence, H, a protecting group, or a substituted or unsubstituted $C_1$-$C_{30}$ alkyl group;
      $W^1$ is —(C=O)—NH—;
      $W^2$ is —O—; and
      $R^2$ is a bond, or
  (2) A is a substituted or unsubstituted $C_1$-$C_{30}$ alkyl group;
      $R^{1b}$, $R^{1c}$, and $R^{1d}$ are H;
      $W^1$ is —(C=O)—NH—;
      $W^2$ is —O—; and
      $R^2$ is a bond.

13. The peptide product of claim 10, wherein A is a substituted or unsubstituted $C_1$-$C_{20}$ alkyl group.

14. The peptide product of claim 9, (SEQ. ID. NO. 149) wherein:
  U is a dibasic natural or unnatural amino acid;
  X is a surfactant of the 1-alkyl glycoside class wherein 1-alkyl is substituted or unsubstituted $C_1$-$C_{20}$ alkyl or a substituted or unsubstituted aralkyl group;
  Z is $NH_2$;
  $aa_1$ is Tyr, Dmt, Nα-Me-Tyr, Nα-Me-Dmt, N,Nα-diMe-Tyr, or N,Nα-diMe-Dmt;
  $aa_2$ is Pro, D-Arg, D-U(X), D-Ala, D-Cit, Tic, or Tic(Ψ[CH2-NH]);
  $aa_3$ is Phe, Trp, Tmp, D- or L-Nal(1), D- or L-Nal(2), CaMePhe, or W-Phe;
  $aa_4$ is Phe, Tmp, D- or L-Nal(1), D- or L-Nal(2), U(X), or D- or L-CαMeU(X); and
  $aa_5$ is absent or Pro, Aib, U(X), or D- or L-CαMeU(X).

15. The peptide product of claim 14, (SEQ. ID. NO. 150) wherein:
  X is comprised of 1-alkyl glucuronic acid or 1-alkyl diglucuronic acid;
  Z is $NH_2$;
  $aa_1$ is Dmt;
  $aa_2$ is Pro, D-Lys(X), Tic, or Tic(Ψ[CH2-NH]);
  $aa_3$ is Phe, Tmp, D- or L-Nal(1), D- or L-Nal(2), or W-Phe;
  $aa_4$ is Phe, D- or L-Nal(1), D- or L-Nal(2), or Lys(X); and
  $aa_5$ is absent or Pro, Aib, Lys(X), or D- or L-CαMeLys(X).

16. The peptide product of claim 15, wherein:
- (1) $aa_1$ is Dmt; (SEQ. ID. NO. 151)
  - $aa_2$ is Pro;
  - $aa_3$ is Phe or Tmp;
  - $aa_4$ is Phe or Lys(X); and
  - $aa_5$ is absent or Aib, Lys(X), or D- or L-CαMeLys(X); or
- (2) $aa_1$ is Dmt; (SEQ. ID. NO. 152)
  - $aa_2$ is Pro;
  - $aa_3$ is Phe or Tmp;
  - $aa_4$ is Phe or Lys(X); and
  - $aa_5$ is absent or Lys(X).

17. The peptide product of claim 9, (SEQ. ID. NO. 153) wherein:
- U is a dibasic natural or unnatural amino acid;
- X is a surfactant of the 1-alkyl glycoside class wherein the 1-alkyl group of the 1-alkyl glycoside is substituted or unsubstituted $C_{1-20}$ alkyl or a substituted or unsubstituted aralkyl group;
- $aa_1$ is Tyr, Dmt, N—$R^3$-Tyr, N—$R^3$-Dmt, N—$(R^3)_2$-Tyr, or N—$(R^3)_2$-Dmt;
- $aa_2$ is D-Arg, D-Cit or D-U(X);
- $aa_3$ is Phe, Trp, D- or L-Nal(1), D- or L-Nal(2), or Tmp;
- $aa_4$ is Phe, Tmp, D- or L-Nal(1), D- or L-Nal(2), U(X), or D- or L-CαMeU(X); and
- $aa_5$ is absent or Pro or U(X).

18. The peptide product of claim 17, (SEQ. ID. NO. 154) wherein:
- X is a surfactant of the 1-alkyl glucuronic acid or 1-alkyl diglucuronic acid class;
- $aa_1$ is Dmt, Nα-Me-Dmt, or N,Nα-diMe-Dmt;
- $aa_2$ is D-Arg, D-Cit, D-Lys(X), or D-Orn(X);
- $aa_3$ is Phe or Tmp;
- $aa_4$ is Phe, Tmp, Lys(X), or Orn(X); and
- $aa_5$ is absent or Pro, Lys(X), or Orn(X).

19. The peptide product of claim 9, wherein:
- (1) U is a dibasic natural or unnatural amino acid; (SEQ. ID. NO. 155)
  - X is a surfactant of the 1-alkyl glycoside class wherein 1-alkyl is substituted or unsubstituted $C_1$-$C_{20}$ alkyl or a substituted or unsubstituted aralkyl group;
  - Z is $NH_2$;
  - $aa_1$ is Tyr, Dmt, N—$R^3$-Tyr, N—$R^3$-Dmt, N—$(R^3)_2$-Tyr, or N—$(R^3)_2$-Dmt;
  - $aa_2$ is Tic or Tic(Ψ[CH2-NH]);
  - $aa_3$ is Phe, Tmp, or Ψ-Phe when $aa_2$ is Tic(Ψ[CH2-NH]);
  - $aa_4$ is Phe, Tmp, D- or L-Nal(1), D- or L-Nal(2), or U(X); and
  - $aa_5$ is absent or Pro, Aib, or U(X); or
- (2) X is a surfactant of the 1-alkyl glucuronic acid or 1-alkyl diglucuronic acid class; (SEQ. ID. NO. 156)
  - $aa_1$ is Tyr, Dmt, Nα-Me-Tyr, Nα-Me-Dmt, N,Nα-diMe-Tyr, or N,Nα-diMe-Dmt;
  - $aa_2$ is Tic or Tic(Ψ[CH2-NH]);
  - $aa_3$ is Phe, Tmp, or Ψ-Phe when $aa_2$ is Tic(Ψ[CH2-NH]);
  - $aa_4$ is Phe, Tmp, D- or L-Nal(1), D- or L-Nal(2), Lys(X), or Orn(X); and
  - $aa_5$ is absent or Aib, Lys(X), or Orn(X); or
- (3) X comprises 1-alkyl glucuronic acid or 1-alkyl diglucuronic acid; (SEQ. ID. NO. 157)
  - $aa_2$ is Tic or Tic(Ψ[CH2-NH]);
  - $aa_3$ is Phe or Ψ-Phe;
  - $aa_4$ is Lys(X); and
  - $aa_5$ is absent.

20. The peptide product of claim 19, (SEQ. ID. NO. 158) wherein:
- X is comprised of 1-alkyl glucuronic acid;
- $aa_2$ is Tic;
- $aa_3$ is Phe;
- $aa_4$ is Lys(X); and
- $aa_5$ is absent.

21. The peptide product of claim 20, which is selected from:

(SEQ. ID. NO. 78)
H-Dmt-Tic-Phe-Lys(N-epsilon-1-methyl beta-D-glucuronyl)-NH$_2$;

(SEQ. ID. NO. 80)
H-Dmt-Tic-Phe-Lys(N-epsilon-1-octyl beta-D-glucuronyl)-NH$_2$;

(SEQ. ID. NO. 81)
H-Dmt-Tic-Phe-Lys(N-epsilon-1-decyl beta-D-glucyronyl)-NH$_2$;

(SEQ. ID. NO. 79)
H-Dmt-Tic-Phe-Lys(N-epsilon-1-dodecyl beta-D-glucuronyl)-NH$_2$;

(SEQ. ID. NO. 160)
H-Dmt-Tic-Phe-Lys(N-epsilon-1-tetradecyl beta-D-glucuronyl)-NH$_2$;

(SEQ. ID. NO. 82)
H-Dmt-Tic-Phe-Lys(N-epsilon-1-hexadecyl beta-D-glucuronyl)-NH$_2$;

(SEQ. ID. NO. 83)
H-Dmt-Tic-Phe-Lys(N-epsilon-1-octadecyl beta-D-glucuronyl)-NH$_2$; and (SEQ. ID. NO. 84)
H-Dmt-Tic-Phe-Lys(N-epsilon-1-eicosyl beta-D-glucuronyl)-NH$_2$.

22. A pharmaceutical composition comprising a therapeutically effective amount of a peptide product of claim 1 or a pharmaceutically acceptable salt thereof, and at least one pharmaceutically acceptable carrier or excipient.

23. The peptide product of claim 8, which is used in the treatment of pain.

24. The peptide product of claim 1, which displays improved duration of action, bioavailability, stability, receptor binding potency or cellular activation potency in comparison to the unmodified peptide not covalently attached to the surfactant X.

* * * * *

UNITED STATES PATENT AND TRADEMARK OFFICE
CERTIFICATE OF CORRECTION

PATENT NO. : 10,005,817 B2
APPLICATION NO. : 14/646246
DATED : June 26, 2018
INVENTOR(S) : John J. Nestor Page 1 of 1

It is certified that error appears in the above-identified patent and that said Letters Patent is hereby corrected as shown below:

On the Title Page

(71) Delete "San Diego, CA (US)" and replace with --Sugar Land, TX (US)--

(72) Delete "Encinitas, CA (US)" and replace with --Sugar Land, TX (US)--

(73) Delete "San Diego, CA (US)" and replace with --Sugar Land, TX (US)--

In the Claims

Column 151, Line 1, delete: "further provided that at least aa1, aa2, aa3, and am" and replace with --further provided that at least aa1, aa2, aa3, and aa4--

Column 152, Line 51, delete: "CaMePh, or W-Phe" and replace with --CαMePh, or Ψ-Phe--

Column 152, Line 63, delete: "W-Phe" and replace with --Ψ-Phe--

Column 154, Line 32, delete: "beta-D-glucyronyl" and replace with --beta-D-glucuronyl--

Signed and Sealed this
Second Day of April, 2019

Andrei Iancu
*Director of the United States Patent and Trademark Office*